United States Patent 6,783,961 (EXPRESSED SEQUENCE TAGS AND ENCODED HUMAN PROTEINS) - sequence listing, part 5

SEQ ID NO: 32313 - DNA, 449 bp, Homo sapiens
  misc_feature 329: b=c or g or t
  misc_feature 330: m=a or c
  misc_feature 419: y=c or t
  misc_feature 420: k=g or t
  misc_feature 423: k=g or t
caaacaaacaaacaaaaaaaactgcatacatatatatctcatttgttgtcctattttagctaacattttaattttctttgcttcacagaagttgtgtgctattgttttctagaaaaggttgtaaaggccaggcgcggtggcttacgcctgtaatcccagcactttgggaggccgaggcaggtggatcgcctgaggtcaggagttcgagaccagtctgaccaataaggtgaaaccccgtctctactaaaaatacaaaaaaaattgattggccgggcgtggtggcaggcgcctgtggtcccagatgctcagcaggttgagacaggagaatbmctgaggtaataggcatgagccactgtgcctggccctcctaggttacttttacatatagcttttttattttattttcatttattatttayktakttatttttgagacagagtctcgctct

SEQ ID NO: 32314 - DNA, 114 bp, Homo sapiens
ccaaagtgctgggattacaggtgtgagccattgtgcccagctcagaaaatttaatagtactagatctcgtgtgtgtgtgtgtgtgtgtgtgcgcgcgcttaggttgaaggtcgg

SEQ ID NO: 32315 - DNA, 488 bp, Homo sapiens
  misc_feature 91: s=g or c
  misc_feature 92: r=a or g
  misc_feature 299: b=c or g or t
  misc_feature 393: m=a or c
  misc_feature 404: r=a or g
  misc_feature 411: r=a or g
  misc_feature 432: k=g or t
  misc_feature 434: b=c or g or t
  misc_feature 437: y=c or t
  misc_feature 446: h=a or c or t
  misc_feature 473: m=a or c
aatatattcgtggagttatgcaactatcaccagtcaattttagatcagtttgatacatgtttttactgaaatacaacaaacaggaaaatgsrcaaatctacatgtaaagttcatatattcacaaagtgaatacacctttgtaatcaccatacatgaaaaaataaaatggtagctccaccttggaagcctcccttatgtccgttcctaagcactacttcctccctctcctaaaggtaatcacatcctgatttcttttttgtttttcttttgagataggatctcactctgtcacccctgabggtgtgcagtggtgagatcacggctcacggcagcctccaattcctgggctcaggtgttcctcccaccttagtctcctgtctgctgagtaattgmgaccacaggcrcacaccragcatacctggctaatttttktbatyatttgtaghaacatggtctccctgtgttgcccaggmtagtttcaaactcct

SEQ ID NO: 32316 - DNA, 419 bp, Homo sapiens
  misc_feature 389: n=a, g, c or t
taaatgtgtcccagagattctggtacgttgtgtctttgttctcattggtttcaaagaacatgtttatttctgccttcatgtcattatttacccagtagtcattcaagagcaagttgttcagtttccatgtagttgagcggttttgagtgagtttcttaatcctgagctctaatttgattgcactgtggtctgagaacagtttgttgtgatttctgttcttttacatttgctgaggagcgctttacttccaactatgtggtcaattttagaataagtgcaatatgttgctcagaagaatgcatattctcttggtttggggtggagagttctgtagatgtctattaggtctgcttggtgcagactaagctcaagtcatgtatatctttgtnaaacatctgtctcactgatctgtctaatat

SEQ ID NO: 32317 - DNA, 260 bp, Homo sapiens
caatcggtgcatattacaaggggggttaagaatctcccatcctattgtcaaggttaacataaatgctcttctaaaatgtttcacttactcctaaactagctatccaaaccttactattaaaagcgcaggcagatttaatttgctaaatagactaacaggaggaaaaaaacaaacagcctagctttaaaaaacagtgaatagcagtgatttcatgtccctgtatgttctgattaagtcttatatgcagagaggacagagcc

SEQ ID NO: 32318 - DNA, 204 bp, Homo sapiens
taggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaacatacga

SEQ ID NO: 32319 - DNA, 237 bp, Homo sapiens
  misc_feature 127: r=a or g
  misc_feature 153: k=g or t
  misc_feature 156: r=a or g
tgaaaaatgggttttttggttaaatatgtctgggcaattttaggttattcaagatttaacaagtatttctattgcaggatttctttgagtctttactatgtattacgaacttatagcattttccaargtttaattgagcataaaacatttttktcrcaaaagactttacaagtcaagtattccagagaactttaaggagcacttttctaagtaaatcttttggaccttaaagcgata

SEQ ID NO: 32320 - DNA, 241 bp, Homo sapiens
ttaagggtaaggggttttgctttcgaatgatggaaatgttttggaagcaggtagaggtggtggttgcacaacatcgtaacatactaaatgccactgaattgtgcactttaaaattgttaattttgttatgaatttcacttcaataagttattaaaaaacaaaaccatagtctctcagtcatgctacttaatgttcctaatgaccataactgagcttccttagacctccccaaaagccctgc

SEQ ID NO: 32321 - DNA, 235 bp, Homo sapiens
  misc_feature 57: m=a or c
  misc_feature 109: s=g or c
atccgtgccgccgcagggagtgtgtcaagttacagaggcgccggaatcggcccctgmgctcctcgccagccgccacgacccacctctgcccatggggccctccatgtgsgccccttcgcccggggactgaaactgactggcccgggagacacgaggcgcccagaaggactgacagcgcggcaccaactgctctgcagacacttgaagggaaagactgggcggagagaaggagatg

SEQ ID NO: 32322 - DNA, 193 bp, Homo sapiens
  misc_feature 2: r=a or g
  misc_feature 41: r=a or g
  misc_feature 84: w=a or t
  misc_feature 99: w=a or t
tratctagagcctcttttaatctagtccttcaattctaggratgttcttgtgctattttttaaataatttccagatatctcatwtccttagtttctctwtctcctataattcagctgttgtatgttctagattgattctctagctttgttatctgttttgttctatttaccatctcttttgttctgcccccta

SEQ ID NO: 32323 - DNA, 181 bp, Homo sapiens
ttttgtcttttccagaatgtcctagagttgggatcatatgtgtgtagccttttcagattggcttcttgcaggtagtaatatgcttttaaatttcttccatgtcttttcttggcttgatgacttattttttcagtgccgaataatattccactgcctggatataccatagtttacccattca

SEQ ID NO: 32324 - DNA, 174 bp, Homo sapiens
atctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctc

SEQ ID NO: 32325 - DNA, 226 bp, Homo sapiens
  misc_feature 23: m=a or c
  misc_feature 24: m=a or c
  misc_feature 44: w=a or t
  misc_feature 65: k=g or t
  misc_feature 71: w=a or t
  misc_feature 98: m=a or c
tataaagtgtttttcaaagcggmmagatactgttaaattcagcwgctaatcatagtgtatttgtktggaawgacatgttgagcaggtagtacctttamggctgttgctttttgcagcattatgtggaagtgcctaagtctatttagcctcacagatgactttagaatcttgtattttctacatcagagttcatagcggggatggtgctacatatatctatgcaact

SEQ ID NO: 32326 - DNA, 326 bp, Homo sapiens
tgtgtagatagcggtgccatggagatctgacaattgagaaaagagaaaattttaaaggggaaaattttaaagtgagaacttggggaatgtggcattctgagtctattttatttgggcatgaatgaaaataggtcttagccgggtagattatcttattataacagtattgtaactcagcactcatgatatggtgctactggaatttaaagtacatctcattctgtagttgaactgcagattgactgatagtggttcaagtgttatgtgatggataatttaaaggctgaagtgttaataatcattgatacgtgctctcactgtggccg

SEQ ID NO: 32327 - DNA, 127 bp, Homo sapiens
  misc_feature 75: k=g or t
  misc_feature 116: k=g or t
  misc_feature 117: k=g or t
caccaggaacccacattaggaagtaaaaaaagagatgctgtttacctttgattctcaatatgagatttcttatckcaggagcacctatggttgaaacagggaaccatgctatagckkgctacaagat

SEQ ID NO: 32328 - DNA, 270 bp, Homo sapiens
  misc_feature 75: k=g or t
  misc_feature 80: w=a or t
  misc_feature 85: r=a or g
  misc_feature 102: d=a or g or t
  misc_feature 112: w=a or t
  misc_feature 117: k=g or t
  misc_feature 151: r=a or g
  misc_feature 169: m=a or c
  misc_feature 221: r=a or g
ctatcaaaaatacattgcttgtggtattaattctcatgtgtgattttagcatattaaaaggctgttttgtgtttktagawccatragaataaatgggatgtdacctttcagwttgtkccaaagattgcatgcatcattaccaaagcttgartctttttactcccctgtmttgttgagatacctactacttgagcatactctggaatgagaaagtttatcgrttaacatgctgcttacgcagataggattagcatttccttaatttagtat

SEQ ID NO: 32329 - DNA, 164 bp, Homo sapiens
  misc_feature 102: r=a or g
  misc_feature 103: r=a or g
  misc_feature 109: r=a or g
  misc_feature 111: r=a or g
gacacacaccccccgcgcggcaccctaagtgtccacaacttttggctgccttacttagcccagggcgcagaggctggaaaggtcgcggggagtatcgtgtgrrtaaagrgrgagatttacaaaatagaagtagtgagaaaggaagaagtgaagggaacggaccg

SEQ ID NO: 32330 - DNA, 183 bp, Homo sapiens
ttcaccatggaatggcgcctctggtattgtgtctcaggtacttcttgaaaggcaagttaatcatgggttgggtcaaagtcctggttttacagtaagacatatggacattagatctactagaggtaaagacatgaaaccttagttttcaaaccaggggtttgagaaacccaagaatgagctccc

SEQ ID NO: 32331 - DNA, 58 bp, Homo sapiens
catgtgtttgtttaaaagtgacctgctactacctcaccattagcccactgggacttgc

SEQ ID NO: 32332 - DNA, 206 bp, Homo sapiens
agagggatctcagctctcgctcggggcccgacctatctcggtccatctaagggtccgcaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccaga

SEQ ID NO: 32333 - DNA, 169 bp, Homo sapiens
  misc_feature 11: v=a or c or g
  misc_feature 12: w=a or t
  misc_feature 166: n=a, g, c or t
caaattgtccvwgtttgcagataacctgattgtatatctagaaaaccccatcgtctcagtccaaaatctcgttaagctgataagcaacttcagcaaagtctcaggatacaaaatcaatgtacaaaaatcacaagcattcttatacaccaataacagacagagagcnaaa

SEQ ID NO: 32334 - DNA, 111 bp, Homo sapiens
caaataggatgttgttagtgcaaattttggggttgatatagtgggagtggtaaagggaacgtcttcttaccaaatagaaataattagaagctttaatcactctacaaacag

SEQ ID NO: 32335 - DNA, 151 bp, Homo sapiens
catcttgcataactatagtacaataaaaccaggaaattggcattgctataatacactgaccttcagatttcatcctctatgtagcttcatgtcagctatcaacacactcagtacataactgttacattgcaggcttcctcatgccaccctc

SEQ ID NO: 32336 - DNA, 142 bp, Homo sapiens
taaattatgataatctacctaattttacctgatttgctacttttctacttataaacagttggagtagtgattaaaagtagtcacattataggcaaatgtatcatatatagataaaactatttttattgaatttgtaccagac

SEQ ID NO: 32337 - DNA, 269 bp, Homo sapiens
  misc_feature 267: h=a or c or t
ctgagtgagcaggcagcgtcatcagggccgccccgcgtgagccctacctgatgtgtctaagccaggctctgtgctgacttcgccagagatgactccacagaccaagatactttgaccgtggcatttgaatacatggtatttttaggtcccggttggtttccctgaaatgaaactcactctgagcttcctgttgtgacgggcgaggagttcaggcggcttcccctccaggagcatctcgaaggcctgcagagagcgtgcaaagcagchgt

SEQ ID NO: 32338 - DNA, 357 bp, Homo sapiens
tcctgtgttagtttgctgagaatgatggtttccagcttcatccatgtccctgcaaaggacatgaactcattcttttttatggctgcatagtattccatggtgtatatgtgccacatttgcttaatccagtctgtaattgatgggcatttgggttggttccaagtctttgctattgtgaacaatgctgcaataaacatacatgtgcatgtgtctttatagtagaatgatttctaatcctttgagtatatacccagtaatgggattgctgggtcaaatggtatttctggttctaggtccttgaggaattgccacactgtcttccacaatggctgaactagtttacaccccaccaaccat

SEQ ID NO: 32339 - DNA, 238 bp, Homo sapiens
aaacgccacacagggcagggctgaaggaagcagcataccgatcctcatctctggccagttcaattccagaaagtgaaaggaaagtgaatgccgaggaggtgcaactatgtaagatactttgcccctggtatgcagaagatctgctgaagaccaatcggcagtaccatggaatagctttataagcaggagtccagccccacaatctctaccgacagtaccgacagacatccccctacag

SEQ ID NO: 32340 - DNA, 363 bp, Homo sapiens
actttcttgaaaagatgaggcctttatccttacgaacacattctgcagactgattctctttggctcaaagatttcctgtcccgtaatggaaagtaggtgtgacgttctgtttgataatcccaggccagagatcttggatgcaggctatttcaacatgggaaactgaaatcgggcatatccctgcggaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccca

SEQ ID NO: 32341 - DNA, 197 bp, Homo sapiens
tttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaaggctttggctgaacaggaagccc

SEQ ID NO: 32342 - DNA, 392 bp, Homo sapiens
  misc_feature 147: s=g or c
  misc_feature 162: y=c or t
  misc_feature 189: n=a, g, c or t
aaaagctctgtaaacatataataaatggaattccattgacattcaagccttacgtatttccagagcttcttcgacttatcctgcctcccctactttaattctgttaaagtagttgaacaccattcttctcataatagttctccctcsattcttcagtgattyccttgtgtttataggataaagtccacntgttattttggcagtcagttcaagatccacaaatcagtctttacccttacatccttatttctcactgctgttctaatatagtctttataccagtcaggctggtctgttcactattcctgaatgtttttctccattcttttgttattggcacccccgctaccctctgcagtgtctttgctacctttctttttctactgtgtgca

SEQ ID NO: 32343 - DNA, 210 bp, Homo sapiens
  misc_feature 113: r=a or g
  misc_feature 133: k=g or t
  misc_feature 143: r=a or g
  misc_feature 144: d=a or g or t
  misc_feature 165: y=c or t
  misc_feature 174: m=a or c
  misc_feature 179: k=g or t
  misc_feature 182: r=a or g
  misc_feature 191: y=c or t
  misc_feature 194: k=g or t
  misc_feature 201: y=c or t
tatagaatgttgtaaaacagacaaacaagaaaacaaaccacatacttttgaagtgtattttatctttatatagtttgtttgcaagagtattttcctaataacttcacagtatraatgtgcatctttttttttkgaacaaatgrdgggggaaccaattttgaccayccataaggmcaaakgtrgatattttyctkaaaaacyctgaggcgg

SEQ ID NO: 32344 - DNA, 517 bp, Homo sapiens
  misc_feature 149: y=c or t
  misc_feature 397: r=a or g
gagataaaaatatagaagaggagaaagcctgaataatttaattattttagattagaactagaaatatcagtgtgaactcatggctcttaacatagctaggtatggaaataaatatatacatgtgtgtaggtatgtgtgtgtgcatcctytttgaagggcatgggaacagtaacacttctacattaataagctgaggaaactgaagttcaaatcgaagtttctaaacactactctccattgaaaggaaccaagattgttggagaaatgactggtttcaggactgggactgagaaaaatgtaagatgaatgcaggaagtaatgagtgctcaagtaatggacagatgtcaaaagaacacagaagcctatttgaaggggttctcactatccaaacctgggrcagtttgtgctttgaaataaattgcattaatgtatattttattgaataaaatatgaacccataagtccacactaaagcatgtagttagaatgatagtattagaaatacatcactggtatc

SEQ ID NO: 32345 - DNA, 270 bp, Homo sapiens
  misc_feature 149: w=a or t
  misc_feature 150: m=a or c
  misc_feature 152: y=c or t
caactataatagcttttaaacttgtttctctttccttttccttcatttcagtccatcttattatctttgacaaaataatttctctgatgcctgactgcctgccccccaacaacaaagcttttattatacttcttaactaatcaactatwmcyttacccatctagccaaagtagactacccatatatgtttcttgaccatgtcaggtttttaacctccatatcttttcttgctctggtcctgtggaatgtctttctcaactctacccgtct

SEQ ID NO: 32346 - DNA, 453 bp, Homo sapiens
  misc_feature 140: w=a or t
  misc_feature 141: k=g or t
  misc_feature 142: k=g or t
  misc_feature 146: r=a or g
cagaccatatgcatatttttcaaaggaaataccctagaactttctctacacctcttgaacttccccagaaaatctgagaatataaaaggatcactggagtaaagaagctttgggatgtgatgattttataaaaagtgtawkkgaarggaaaaaatcggggtgcaggtgaaggggtcctgttcacttatctcaaggttggttaggtgggggcttcagtggagtatcctgagacctgttgtgtgatctttgcacttaggaagagctgactcaggactgacaccttacaggaaatctggaaggccagaggtagctgcttagctgctagggaagttactgttgttttgaaaatgactgacatccccaaagttaggcactggccagggaaatgggattgccatgattgaataagacaaaggaagtggagatggtataggtttcctgatcaataagtgt

SEQ ID NO: 32347 - DNA, 485 bp, Homo sapiens
cccttcatagctgcccgagagatttgggggacatgggtattgccagcgcagagtgaagccccggcgtgtgctagcccttgtgtgggcagctgggtcaggctcctttcttaagaaaacaatccggctcagggtcctcaccgccctttgtttgtcctccccacgaggtgatcagttgaagtctctgtggtgacagaaccagtttgtaacaggcttgtctttcacggtcctgtctcagggttgctggcaggcttgcgagaagatctgacaagagtggcagcagaggcgtctcagtgaaagacggaaaggcaagaaacaggaggcttaaacaggcagggcacattgactgctctgctgctgcaatgggttggctggaagaactaaactggcagcttcacattttcttgctcattcttctctctatgcacacaaggggtaagaagatcagtgcctccactacagtgctgatggggctgagtagagtctga

SEQ ID NO: 32348 - DNA, 306 bp, Homo sapiens
tttaaattaagttataaattacaattgaagaacaatattttgatgtgtgagaccagagatgtcagagcagggagatgtaattcatgggttcattatagaacagaggtgcctgacagctgagccatgccaaaaggaaaatttatttgcaacatcacgcagacagaaaatggtagctaagatgagaagccagaatagaaacttgaaaccttgtggtaatacgcagagtttatgctaataagactgcctgagatccagggatgtttaatgactgctgtaatattaatgaggtgcttggacacgtgcgcc

SEQ ID NO: 32349 - DNA, 229 bp, Homo sapiens
  misc_feature 217: n=a, g, c or t
ttataagaaacattaaaattctctgaaaatttcagttttttcccttttttcaaagagaaaaacaattataggagacttctcctggcttcacagtttctggatgctgtgtttttgttaactgtaacactttgaaatagcatttgctaaaaaaccttttttctttctctcttttttggtgatgtggcagagagaaagacattgagatgttccttgagtncagccgcagcgc

SEQ ID NO: 32350 - DNA, 265 bp, Homo sapiens
taaggtgggatgggggtcagacagtttcatgcatgcagggtagctatttccctaagtggtagctctaaattttctttgatgttaagtaagttacttaactttgctgtttatctttctctttttttcagtatatgggagtccacatttatgtaaagaaatgaaactataaaatgtataaataatttgcaaatcagaattgctgtcgaaagttttactataatgaaagatattttcatactctcaaaaatatagaggaaaggggcct

SEQ ID NO: 32351 - DNA, 348 bp, Homo sapiens
tggtttctgcactttactgtactgtttttttatatgataatattttcctggttgaatgattcgttcttttgagtaaactccatggtcaaacaattactttttattagtcaaagatgtaaccacataatcactaaaaagaacagtgtgacttatttaaaggggattatgtttttaagtcttttatatagctttgtagggaggccatatgagtttaaggacagttcgtggcatttgttcaaggttttgtaacttggcatctcagcagccaccaggataccagatcatcgttctaagtaagatttaggcattttagccttcatgtacagactataagtacacccccccaca

SEQ ID NO: 32352 - DNA, 405 bp, Homo sapiens
  misc_feature 208: d=a or g or t
  misc_feature 215: n=a, g, c or t
  misc_feature 237: y=c or t
aaaggagcatactttgacataataaaaaggagtatatttggacatagcatgaatgtccattacattactggacatttggtcatatgtaaccagaaattgacattagggttgttctgggatttatatgttaattcctaaaaatgatgggaataaaatttcctttggtctgcacagtttgcattatcccattggattaaacacctccacdaccagcnagtgagggttcaggagaaaaaycatattactgatagataaaataaagaactgacttgttttcatcacatttgagcttgtagagtgagtaaattttgttagccccactatcattaaattgtcattgtgacttggtggagcttggccaacggtctgagcaagatttccaggttaactctgaaatacatattt

SEQ ID NO: 32353 - DNA, 162 bp, Homo sapiens
  misc_feature 137: r=a or g
tgcacacatgaaaagggcaaaaagtaaccgtccttgacagggagtcttaactagagaaggaaacgggactaaactggcgggctccgtggaagcgtggccggcagcgtcccggacgaggaggtgaggaggaaagagargatgtgtggactccggggggcgcac

SEQ ID NO: 32354 - DNA, 418 bp, Homo sapiens
  misc_feature 124: r=a or g
  misc_feature 140: w=a or t
  misc_feature 148: w=a or t
cattgttggcttatttttatttttattttttaacatttcaaacctttagtcagacaggaactgacttgtgtgaagtgtctatcttgttttctcagcttctatagcagtatcaactacgtatagrttatgctaagaaagtwatgtaatwaaatactgtcaatgtacatttgaaagcaagtttgcagtgaatcacctatccagggaataatcctgggttgtcctgtaagagtacttagaaatgcaacagatgtacactgcgttgcccagcttcccctttgtttatatgctgctttttaaaaaattgaggaataagttgtttggcatattcttttcgtagacctctttgtgatcgggtttttttcaagggtaaaaatctgattgcttttttaattcattgaaatgctggattttgttgttt

SEQ ID NO: 32355 - DNA, 451 bp, Homo sapiens
  misc_feature 134: s=g or c
tcctaaatttgagcaagtgtacctacgctgcccaccaattccttcccatagaaaccaaggtgctgagccatgcttccttcccctcataccttctgcctcctgacgagctcagacacttccccatatagctctgsattttttttgtgtggcatatccctctctttcaggaaatttaagtaataataaactcttctttcaaaggcggttgtctccaggtctgtcaccttaccatacttggttaaaacgaatcccaggtatatttcaagacaggacaccatctcactttcattaacaagaacctaagtgtgcttaatactctccagtttataaagcaccttcatatctcttatgatttaattaatcacaacagtcccttaaggaggtaatcccagtttagagataataaacagtaattagacattttctgatacagattcaagctgccagatcc

SEQ ID NO: 32356 - DNA, 490 bp, Homo sapiens
  misc_feature 132: m=a or c
  misc_feature 133: r=a or g
  misc_feature 135: r=a or g
  misc_feature 139: m=a or c
  misc_feature 144: k=g or t
  misc_feature 284: n=a, g, c or t
  misc_feature 415: r=a or g
  misc_feature 470: m=a or c
ttcagactataacatttggctgccacgtctcatttttagtgacaattttagtgttttgccttttctcaaatgtgtgacagaaaattatttttgtccaagtgatccatgcacttggtaacaaatccaatatamrgragamcattkgttgaaaaacaatggtttccttcacctcctcaaggctcacagagggaaacttttaatttttttcaactgtacccatatttaattcttagattgttaccttcttaagcttaagtaatgtgcttttaccaccatgttttganttatcaacttttagcacctgatatgaaagtgagaatgtagctctttaagctagttttcttttttctctcccaggtttgatgtttataatattttaaatttgtctgtctctgtcacccaggctggagtgcartgggaatcatagctcactgaagcctcaaattcctgggctcaagtgatcctcccamctcagcttcctgagtaacta

SEQ ID NO: 32357 - DNA, 267 bp, Homo sapiens
  misc_feature 136: w=a or t
  misc_feature 143: k=g or t
  misc_feature 146: w=a or t
atgattatttttaggaatttggacgatatggaaaataggaaaaagttagaaaaatcacccatagttcttatcacccaaagacagccctggtttacattttgtgatttccttctagtcttacatctttattaatttwaaaaatkgtwaatttttagatttaacttttaaactaaatagtaaaaattgtaattataaatataaaacaaacttccttattgtaaaaacacattacaaataggaagaaaataaaagtttaaattacacccc

SEQ ID NO: 32358 - DNA, 104 bp, Homo sapiens
ttcttgttgaattgatccctttaccattatgtaatggccttgtctcttgacctttgttggtttaaagtcggttttattggagactaggactgcaacccctgcta

SEQ ID NO: 32359 - DNA, 443 bp, Homo sapiens
  misc_feature 144: k=g or t
  misc_feature 227: r=a or g
  misc_feature 228: h=a or c or t
aattcgaatacaaattaagacaaaaaattggggtaggctcatcctccattctcactttgtttatagtgagacctgtgatagtcacatttgaaattaatcttaaagtctttagttagagatagtttcctacctttaatcattgtkactaaactgtttaaaaactgggagggaaaattgaaaagtctgccacactggacatttctttgtttcaaaaattgagtgttttrhaggcgtctgggtactctgggaggattccaagctgcttgtcatgttgatactctcaaacctgtacttgagtcagggagacagccataactacatacaataaaagcataaagggggaattagaactaggggagagtattgacaggtgggactcacctaattcaaggctaccagtaggtatttgtatgctgtgtacctttctagtctttttagtaaca

SEQ ID NO: 32360 - DNA, 465 bp, Homo sapiens
  misc_feature 337: v=a or c or g
cgttcttctgtcatggcttcagccggttcctccgtttggggtccctgacttcctgcaacaccttcttatatgtatcaaaactcatactgaacaatgagttctgggttgcaaaagaggatttattttttgcacctaaccataagtctttgtcacaagttaaacaaaaacagtgtagtatacagtatttttaataattttgtgcattaaataaaatttgtgtaccttgaatcattagaaaacaagtattaggtgtggagtttttcacttgtggcatcatgttagaattcaaaaagtttcagagtttggagcatcttggatttcggatttttccaattavgaatgctcaacctaatcagaagtaagacttggatattaaaagtttgaaagccacggttttatttgcttagtagtatataactgcaacagtactttttatcttaattattgtgtagaatctgatgactc

SEQ ID NO: 32361 - DNA, 414 bp, Homo sapiens
cccaaccaaaaagacattgttttatggcataaatccaaaagaatcaaagaataggtaaggagacaataatcaaaacctcttagaaattagaaagttgatgcatgctaacagatttgctgaaacttagaaaaagtaatatgaagtagcagagaggaaacagagtcagttcgatttacatccagagtcaggtattgacaacacgagatgcaatggaagaaagagcaaaataaggaagactgggtggaagtcagttttaagaggcagtcaggtccccaaatcccattccctactcccatcccagagactgggggcatatttcttcctggagggaactttttctttttgagatgataaagaaaaggttgggccgggcgcgatggctcacgcctgtagtcccagcactttgggaggcat

SEQ ID NO: 32362 - DNA, 456 bp, Homo sapiens
ccatatcgtgaaatttttattaatttttttctttttcctttgttacttctttatcttttcctttcttcagactccgtccaaggagatgctctccccggtcttctgctgcaatttagattcctttcccttctctccagttctcttccctttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctc

SEQ ID NO: 32363 - DNA, 308 bp, Homo sapiens
caaaatattgcaaagagttttctaagtctctgaagatttttttctccttgaacactgagtctatagcagtcagcaatgtaccttagccgatccctgggaatggttatggaacagtagggcttgtttccatcctttttagagtgaagaggatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccta

SEQ ID NO: 32364 - DNA, 416 bp, Homo sapiens
  misc_feature 23: w=a or t
  misc_feature 142: m=a or c
  misc_feature 148: b=c or g or t
  misc_feature 267: r=a or g
  misc_feature 271: r=a or g
  misc_feature 292: s=g or c
  misc_feature 307: h=a or c or t
  misc_feature 311: s=g or c
  misc_feature 315: s=g or c
ttttaggcattgctgtgtaagtwttggtggtgcgtgggtacaatgaagccaggagggatagaaagggaaatgatgtgtgtgctgcaggctaaacaggggctcttccttatgcctcataaccacctgtgtgtgacagtttcamcatttbcctatcaaattattatcttcattcatttctacttgtgaatgaagttcggagactaagaaaaagccagctgttggaatagaaagcactttaggataaaatggtcttgttaaaatcaccarttaraaagttaagcccctgatgtasaaataactaaaacahatasatasaaagacagtgcttcttgttcaatgatttacttcacagctgattcataatcaaatgaacaagaatctgcaagaacagaacatggtgggcagggtccagtaat

SEQ ID NO: 32365 - DNA, 431 bp, Homo sapiens
  misc_feature 142: y=c or t
  misc_feature 147: k=g or t
  misc_feature 212: n=a, g, c or t
  misc_feature 232: d=a or g or t
  misc_feature 374: n=a, g, c or t
  misc_feature 375: k=g or t
  misc_feature 384: k=g or t
agatattgcccagcctgtccagctgcagaggaactgggctgagtgtccgctggtgttcccgcatcacctgctggactcgttccatcacctgatagaacacgggctctgaggctggtgtgaggatgtgggtctcagaaagggyctctkgagaggtcaaagagcaaaggtagatcgtggtggactactttttccccaaagcacaggcagacctntcttccatagcaggcaccgdctccctctggctggaacacaggcgtcacaaagtggagttccacattgttcctcctggtggaaagataataattacagagttggcatagagaaatagggtgccttgctggtgaatggcatcttcatagggctaaaaggtaatnkttctttttkttgtgcaagagtcttggtctgtcgcccaggctggagtgcagtggtgc

SEQ ID NO: 32366 - DNA, 360 bp, Homo sapiens
  misc_feature 135: w=a or t
  misc_feature 148: w=a or t
ataatcttaggttttgtgttcatgtctatgatcaattttgagttagtttttgtatgtggttaaaaagtatggattgaagttctctttttttaagcctgagattgggcatatacattgatttttttaagaaaatawttttaattgagawaataattacaatgccatagcattcactgatttaaagtgtacaattaaatggtttttagcataatcacagagttcagcaacagttaacaacaatctgtttaaaatattttcgtcaccccagaaacacagcccttgcccattcgcagtccttcctctgttctttctatggatttgcctactctagacatgacatataatgaaatcatacaatat

SEQ ID NO: 32367 - DNA, 123 bp, Homo sapiens
tcattcatgattcatgactcctgttttgttgcctcttaacacacacaaagaagtcgtgaagcaatcaagtcagggacttgttgaaagtcaccttgtaaacataatttccaaaagcccaaggaa

SEQ ID NO: 32368 - DNA, 468 bp, Homo sapiens
  misc_feature 144: r=a or g
  misc_feature 147: k=g or t
  misc_feature 378: n=a, g, c or t
caatgtgaaaataaaatataaaaactgttcttagagttatttctaaacagtactaacatcagaatcgtcccaatcatcagaatgtctgttttttaaaagtcagatttatcaaatcaatcttcggccaacaaccttttttggagraakgatgtaaacatcacacataggaattccgcattttctaggatttgacattttcagctattgaaaattactatattttgtaaatggacgtaccgctactaaaaacagaatgcttgaaatagaatgtcttttgtttccaaagtcagtacactagagctatgtgaaaataatcataaaagtgaagatattttatggcagagttatgttggggcaaatgctgcagctgcaagcggntgctggcaaatattgtcggagcaagtgggaaaaggattaaagatgtttatatgctgattataatgatctaataaaggggggaaatgatgc

SEQ ID NO: 32369 - DNA, 209 bp, Homo sapiens
  misc_feature 133: s=g or c
  misc_feature 136: s=g or c
  misc_feature 144: n=a, g, c or t
gctgcaactgctgacggcagctaatctgacatttgtctcattgaagtggaagagcagatgtgttgcactggagtcctcttgcaggtcttccgttctgaaggctgcactctgcgtcacagtgtcctagacttgstgsaagccctnccagctggcccaaaagtcagatgtcctggcttaagctgctgaagccaccttggaccatgagtgac

SEQ ID NO: 32370 - DNA, 418 bp, Homo sapiens
  misc_feature 148: s=g or c
  misc_feature 152: s=g or c
  misc_feature 154: s=g or c
  misc_feature 157: y=c or t
  misc_feature 286: w=a or t
  misc_feature 287: n=a, g, c or t
tgtccttgtcagggctaggacggggtacagagcaaatagcccttgaggaatcaggctcagaggaaagcaagtctcaagcatctccccacaggggagagcctgaacccctgcccatgaaagctaaagaggaaaagcaaggcgatatagsaagscsacytccagtctggccacacccgagccttacgaatgcccctctgtgagacttgagcacaaacttataatgagcaaggccaggtagggggagggccgtggattttcatctaccagcccttccctatgacagacwncctaaattggaaacaacgtactccttcccatacagagaagcctgaggctgtcatagacttgatgaggtccatttttctgactcataaccccacctggccagactgccagcagcaacttctgacactgcttc

SEQ ID NO: 32371 - DNA, 429 bp, Homo sapiens
  misc_feature 153: k=g or t
  misc_feature 162: r=a or g
  misc_feature 198: h=a or c or t
  misc_feature 377: r=a or g
cttaagtaaaaagaattagaagacattctttcattttcgaaactataataagcaaagccctgtggttttggcataatgatagacataaaaggaatagaatagagagttcaaaaataggcctgtagaggctgggctcagtggctcatgcctggkaatttcccrgcactttgagaggctgaggcagaaggattgcttgahagccaggagtttgagaccagcttgggcagcaaagtgagaccttgtctctacaagaaaaatttaaaaaaaaaaacaacaacagaaactaggcaggtgtggtggtgaatacctgtcatctcagctacttgggaggctagggcaggaggattgcttgagccaaggagtttgaggctgcagtragctgtgatcgggctactgtactccagcctgggtgactgagaccctggctct

SEQ ID NO: 32372 - DNA, 451 bp, Homo sapiens
  misc_feature 154: r=a or g
  misc_feature 429: r=a or g
caaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaaattgrggtagagattgccgaagaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattgaagaagatggctgtccatctgaccccacgagcaaacaggagcacatgaaatcacactccactgagagtttcaagtgtgaaatatgcaataarcgatatcttcgagagagcgcat

SEQ ID NO: 32373 - DNA, 191 bp, Homo sapiens
  misc_feature 127: r=a or g
agaggccttgagaaagagagcgatagagtgcgagagcgagtgcccggagcatcctggccctgagacagctgggccagccccgcaggctctgcagcatgtgggagctccgctccatagccttctccarggctgtgttcgcagagttcctggccacactcctcttcgtcttctttggcctcggctctgccccc

SEQ ID NO: 32374 - DNA, 449 bp, Homo sapiens
  misc_feature 147: r=a or g
  misc_feature 250: d=a or g or t
  misc_feature 251: m=a or c
  misc_feature 273: n=a, g, c or t
aagaaaatattagagtacatcacattggtaagattatgtgaaacttttatgttagatatgtatgtacacacttgtacatcctatggggaagtgtgtgacaatagaagatgtgtttcttattgtgagttgggagtcaaaaaagtgtartgagccattgtactatgacagaggaagatctcagtctcatctgttaagttctgtgagagcaggaaccaagagttttctttaccttagtagcctccagtgcttdmtatatagctgagcacatagtcntgtttactgaaggaagaaaggaatagaaagaggaggaagatgatcatctaagctaagatcggtttttctttttgtacctttcaatatggttttgaagtataatttacatacagtaactaaacttaagtgttacagtttcaagagttttgacaaatttgtacatctttgtaatctat

SEQ ID NO: 32375 - DNA, 265 bp, Homo sapiens
cctcaagtgatctgcccgcttcggcctcccaaggtgctgggattgcaggcatgagccactgtgcctagccagtttgtaacatttctgctgtgtttgtgctgttgagcagagatattgtgggttctatgtagctcataggattattgcaatgatcaaatgaaataatgttttataattttaaagcaccatagaaagatttgttaagttctatgtatttttaatttttaattatgatttctttctcgactaacatatgtatgaggca

SEQ ID NO: 32376 - DNA, 212 bp, Homo sapiens
  misc_feature 136: s=g or c
  misc_feature 140: k=g or t
aataagatccagagtctcctaacataacacccaaaatgtctgggaaacaactgaaaatcacttatcataccaagaaacaggaaaatctcaacttgaatgagaaaagacaatcaaaagatgccaacgtggtatgtgsgttkgtattatctgattaagattttaaagtagccatcacaaatgtgcttcaatgggcaattaaaaacggacatggt

SEQ ID NO: 32377 - DNA, 305 bp, Homo sapiens
  misc_feature 141: k=g or t
atgggagattggagttttgggggaggtggataggatatgatgctagaaatgtacatagatccaaattatgtaaaatggtatgtgctatgctgaagagattgtcatcttgccttgactttaggacagatttctctatttctkgcaaaaaaatgttgggattttgggatttgggattttgataggtaatgcattgaatctgtagattgctttatatagtattgacatcttaacaatattgttttgtagtccatgaacacgggatacctttctattagtgtcttctatatttcttttttttttttttt

SEQ ID NO: 32378 - DNA, 459 bp, Homo sapiens
  misc_feature 136: s=g or c
  misc_feature 144: r=a or g
tttgtctttctgtgcctggcttaagaaataattgatttttaaataaagtaatcctttttgatgaaaccttaaagggcaattaaagatactatatccagttgtaggcagtagaaaaatctgtaaaagtaaatacagsctttgggrgcaacattttaaactttttaattattaaagtgaagtaagcatattatcctaagtgattttcttaatcttttatcagtttctaaagatgcacatttttatgcagttacagtatatttgaagttccgtgcaatctgtcctgttgctctgtaattttcttgattattacaaatgttgcaaaagtctgcaaagttttcatccagcaagtttgcttaagcctatatgcaatggtttcctctatgttgaataatgaatatttgtttatttattttttgagacggagttttgctcttgttgcccaggctggagtgcaatggc

SEQ ID NO: 32379 - DNA, 356 bp, Homo sapiens
  misc_feature 200: n=a, g, c or t
  misc_feature 201: b=c or g or t
  misc_feature 202: r=a or g
  misc_feature 289: w=a or t
  misc_feature 305: m=a or c
caacagtgtgttttagtttttagtatatagatcttgctcatagtttgctagatttatactaaatattttgtggtttttggtatgattataaatggtatctcttaaaatttaaatttccagttgtctcttgctagttgtggaaatgtaattgatttttatttattgaccttatattgtgcagctttgctgaactcacttanbragtttcaggaattttttttttgtaggcttttgggatttttaaaaagtagataatcatctcacctatgaataaaatattttttgcctwattactctggctaggmcctacagtgtgatatggaataaaactggtgaaagtgaatagtttgctttgt

SEQ ID NO: 32380 - DNA, 462 bp, Homo sapiens
  misc_feature 230: h=a or c or t
  misc_feature 366: v=a or c or g
ctaaatattttctaagataatttgaaagcaagggaaatagtggccccttaatgattatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgchtgcagtaaagattctcagggtgtcagagcagcatattgtcaaatcctgcttctgttttatgtttcagtgtattcactttcattttcttacttactagaccatttctgcagtttgcccaaacctctactgtttgggvcagtaagccaaatacctcatttttaaaaagaagttttcatggcatcagtgttaataaagtacatttttaactgagtcttaatctctatttgaagaa

SEQ ID NO: 32381 - DNA, 174 bp, Homo sapiens
acaatggacccataaccaaaactttaaaaaatggttacttatggtggaggcaggaggagaggaaccagatggaaaggaccaggatggaagctagatttctcagaatatatcttgaattttcaacatttgactttggtacatatgttattctaaaacgagatttaagcaaagttt

SEQ ID NO: 32382 - DNA, 368 bp, Homo sapiens
  misc_feature 138: r=a or g
  misc_feature 139: y=c or t
  misc_feature 140: k=g or t
  misc_feature 143: m=a or c
tccaataaaaagccataactgtcctaaatgtatacatacccaacattgaagcagccagtttcataaaacagtttcttcttggcctatgaaaagacttcgacaaccacacagtaatagtaggagacttcaacaaggcarykgamcagtgttagaaatatcactgaggcagaaaactaataaactctggatgttaactcaacatgtgaccaactggaccaaatggacatctacagaacactccatccaactactgcagaatatatattattttcatgtgcatgtgggacatagattctaagagcaaccacatgctcagtcataaggcaaatcttaataaatttaaaaacaaatgaaatcataccaagcta

SEQ ID NO: 32383 - DNA, 59 bp, Homo sapiens
  misc_feature 21: k=g or t
catttgtaaattctaaatggkcaccataaaatgtattaggtaggagaagatacgtttta

SEQ ID NO: 32384 - DNA, 126 bp, Homo sapiens
tacacattgggtacagtgtacactgcttaggtgatgggtgcaccaaaatctcagaaatcaccactaaagaacttactcctgtaaccagacacacctgctccctgaaaacatattgaaatggaaaat

SEQ ID NO: 32385 - DNA, 162 bp, Homo sapiens
  misc_feature 140: r=a or g
  misc_feature 141: w=a or t
taatatagatctttaatttctctcagcaatgattatagttcacaatgtggaggatttacatgtctttcattaaatttatccaaagtactttatggtttttgatactttaaaaagtagaattgttctttttttaaattcgrwtttcccaatcatttgcagccg

SEQ ID NO: 32386 - DNA, 461 bp, Homo sapiens
  misc_feature 133: m=a or c
  misc_feature 135: w=a or t
  misc_feature 139: m=a or c
  misc_feature 140: b=c or g or t
  misc_feature 300: s=g or c
  misc_feature 301: k=g or t
  misc_feature 303: n=a, g, c or t
  misc_feature 334: m=a or c
agattgtggcagtttttgcacaactttgaaatagaaatacctggtactctatcttgtttattgttgatgccatcttagaggaaaaaatgtaaaggtaagtaattaagcatatgacagcaacaaataagatacmtwaaambtacgaagtaaagtccccattaggttataagtattacaaaaaatccacctttctctaaggggaagtttgtaccccattgattcttggtgcctttgggatcgactgggttttaatggcctagttatttgaggattttgctgtgttgttttccatgtcttctskgntcaccttggattatatataaaaatacaggamatagataaacatgaatgtgattaataatgctgaaaaagtattagcctaccaaagacacactcaggctttagtgaataactttacataacctcagtttttaacacatgcatatcttctccaaccatga

SEQ ID NO: 32387 - DNA, 417 bp, Homo sapiens
  misc_feature 151: m=a or c
catatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaamcattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatat

SEQ ID NO: 32388 - DNA, 238 bp, Homo sapiens
  misc_feature 151: w=a or t
  misc_feature 155: k=g or t
  misc_feature 157: k=g or t
  misc_feature 212: n=a, g, c or t
atgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaaacaawtggkgkgcttctatttataccaaggtttgggattaaaggtgctgcttatctaaaaaataangatggtttagtcatctcatgtggccc

SEQ ID NO: 32389 - DNA, 245 bp, Homo sapiens
  misc_feature 46: h=a or c or t
  misc_feature 158: n=a, g, c or t
  misc_feature 160: n=a, g, c or t
  misc_feature 161: k=g or t
ttttttatttcttccgctctggaacgcgggagaaaagtggcgagghagtttttcctcctgtctcgtgtctgttgccccgcgcggggaggggagacaggccctaggagaaggccgggcttggtgcctgctgaagggtggtgtgggcgtgggtgaccccntnktgctcacactgacccgtccagtctctgcctgggagagctttggaccgtttgtgcgcacggggtgacttcctgtctttctctcct

SEQ ID NO: 32390 - DNA, 240 bp, Homo sapiens
  misc_feature 184: y=c or t
  misc_feature 185: m=a or c
agtactgggattacaggtgtgagccattgtgcttggccaacttcatttctaaataactaaaatttccttagctctgtttctactaggtaatagagaacaatcctgctaaacaatcttgccactttaggataaaaagtcagtagcttctgggcttaactaaattaattacatgttaatctaaacymttggtaaatacttggtccttttggtaaatgttcagtttcctcacagaaccctccg

SEQ ID NO: 32391 - DNA, 347 bp, Homo sapiens
  misc_feature 272: n=a, g, c or t
aatgcgtcacttccaagggtacccatgaaggataccataggtagttttggagtctatctccctagtataaaccataatgtgatttattacttaagtaaagctgacttttccccatggcagttgcaaccagaggtaaacgtctctcatgcattttcactcagtgccgttggttatttagttttctctcccctgtacctttaacatctcttcttgtatttactctttttccctctccttttgacaactccatcctcatctgactattacactgnctgtctcctatccttgacagccacatttcttaaaagagtaattacattcattgtttttacttcttcaagtcccac

SEQ ID NO: 32392 - DNA, 487 bp, Homo sapiens
  misc_feature 154: k=g or t
  misc_feature 396: d=a or g or t
  misc_feature 397: s=g or c
  misc_feature 456: w=a or t
tttggagcctcggagtttttcactgaggcaggggtcagctgaaagacaaagaaaaatggcgaatagtttgttggggggtgggaggacagctgttcgggttttcagtggagtggacattccagactcatgtttctgcatctcctgctgccttttkgtttcctccgtcctttggggggtagggataggagtgacttaaattctcccagtcggtggaggtataaataactacatgtaaaattaatgcagttcccgttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactgdstggtattaagaagatatgaaactggatgaagatgtgaaggtgaattcacattcattttwattatttcttattgaagctaagtgatgggta

SEQ ID NO: 32393 - DNA, 513 bp, Homo sapiens
  misc_feature 148: r=a or g
cggagtttgtataaaacccatattttcattacttcctaactctgataattataggggatatattttaaggattaaaactagtatcttaaatgtttttatatcagtcagtttaaaaactaatattcagtttagtctttcagaactttgragtccacgaaatgcatctttaaaagcagggtacatttattgaaataaaacactctacagtgatctggatctttttttaatttatttttttattatacttttaagttctgggatacatgtgcagaatgtgcaggcttgttacataggtatacacgtgccacggtggtttactgcacccatcaacctgtcatctacattaggtatttctcctaatgctatccctcccctaccatcccaccccctgacaggcgccttggtgtgtgatgttggatcgttttttttcttgaacatacaaacgttagtacataccttttctgtttgtatgcagacatatgaatgttttttcagaagaggagttacactgta

SEQ ID NO: 32394 - DNA, 251 bp, Homo sapiens
  misc_feature 130: m=a or c
  misc_feature 138: w=a or t
  misc_feature 228: n=a, g, c or t
ttaacaggaaaaagaaaatatcatgctgaaacctcttggccaccataagaatgcacattgcagccatcgaaccacagtcagcatgattgaccaaagggcccagctgctggcttgaaatcctttggctggmatttgccwagtgactagttgggatactaaagtaggcccattcctgggagtcacggggctccccagtggcctcattgaaacttccttagactacaccanaatgtggtatgcttccacccgat

SEQ ID NO: 32395 - DNA, 279 bp, Homo sapiens
  misc_feature 125: n=a, g, c or t
  misc_feature 126: k=g or t
  misc_feature 130: w=a or t
  misc_feature 136: r=a or g
ttgtaaataaatttttctccctcagcggtcccagggatgtaaaaacaatatcagatcattgcttcagaactgacagactctaaacatggaaacaacaaaagataaaacaaagcatcttcagaacnkcctwagatcrgagaggaagctctgaagaggctgtcagccctcctctaagcaccaggctgacaccaccactttgaaacacagcaataaagtcatgactttcaaagacacagatatgagaaatgctacgtacgctgtggcaaataaacccctcct

SEQ ID NO: 32396 - DNA, 344 bp, Homo sapiens
  misc_feature 128: w=a or t
  misc_feature 131: k=g or t
  misc_feature 137: k=g or t
  misc_feature 192: k=g or t
  misc_feature 193: s=g or c
aatatattcataatatcactgaatcattaacctatgaattgaatataatgttacatgatattatagacatgtaatcaaacatatgcacatgtatacctataacataggcacatgtataactataaccwtakgcccakgtatacatctgggtgcttgatggtttacaaattgggtgttggggaccatctcctkstagcttttctctctcattcaagccccagggaaacagaggtgagctgatttatgtgcaggtctccagttttgtgtggtctttatattgttagaacagtctctgtatctatctttatggacccgatacaaatattgtaataaagccatcacat

SEQ ID NO: 32397 - DNA, 301 bp, Homo sapiens
  misc_feature 128: k=g or t
  misc_feature 131: r=a or g
  misc_feature 133: k=g or t
  misc_feature 140: k=g or t
  misc_feature 141: k=g or t
tagctaaaagtgtggtttatctaaaccgttttaataagcaagatgactgggaaatctctgccccttttctgagcagtatgcctcttcttttagaattaaatgaatgctgcacaggtccagatgtgtgktgrakgtagackkgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggcagca

SEQ ID NO: 32398 - DNA, 225 bp, Homo sapiens
  misc_feature 129: s=g or c
  misc_feature 130: m=a or c
  misc_feature 132: d=a or g or t
  misc_feature 135: w=a or t
  misc_feature 158: v=a or c or g
  misc_feature 194: s=g or c
  misc_feature 219: m=a or c
agtgccaggctggaggcggcagcggttggaggcttcgcccggctttgcagcggggacttcggcggcggcgcctcaggcacctcggcccggacacgatgaggcgagtggtacgacagagcaagtttcggsmadgtwtttgggcaagcggtgaaaaatgvccagtgctatgatgacatccgggtttctcgtgtgasctgggatagttccttttgtgctgtmaatcca

SEQ ID NO: 32399 - DNA, 439 bp, Homo sapiens
tctagatatgacatttggttcgggagggcacacaaaagccattctgcagaaggagtcagatattgttctctatgccttggacagagacccaacagcttatgcattagctgaacatctttcagagttgtatcctaaacaaatccgagcctatgctgggccagttcagccaggcagaagccttattaatgaaagctggggtgcagccaggaacttttgatggagttcttatggatcttgggtgttcctccatgcaacttgatactcctgaaagaggtttttcccttcggaaagatggccctttggacatgagaatggatggtggcagatcaacaggcacttgcatctatcctaagaacatacggggaggagaagcatgccaagaaaatcgcttcagcaattgttcaggcacgcagcatctaccccatcaccagaacccagc

SEQ ID NO: 32400 - DNA, 314 bp, Homo sapiens
cagtataaattttaattattccaggaatatgcataatattgaaatatttcatgtcctattttaatagaaaacctcagggcccaagtaacagtgatagaagttagaaaaacctttacttagaattgtccacctagtcagaagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgtt

SEQ ID NO: 32401 - DNA, 354 bp, Homo sapiens
  misc_feature 155: m=a or c
cctatcaaggttaacatcaacaccaagccaaatagtactagactataaaatgcaccaaatcttgctttacttttctctttgacaaacatgagtttttaaaccaatgaacggtctgaagtttgactatgactcagttccttctaagtgctctacamcagagtacaaaaggttaccaaatcctccagtttctgacacagaaatccaatttggaatgaaggaaataaacgtcccactctttaacagctaaagatgttactgatgacatctaagaatttggagtttcaaaatgtgaattgtgaaaacatttgaatctcttcataatggaaaggacttggaaatggaaaagaaatacgc

SEQ ID NO: 32402 - DNA, 500 bp, Homo sapiens
  misc_feature 123: s=g or c
  misc_feature 124: h=a or c or t
  misc_feature 345: h=a or c or t
  misc_feature 346: n=a, g, c or t
  misc_feature 356: y=c or t
  misc_feature 385: n=a, g, c or t
  misc_feature 398: n=a, g, c or t
tgtatttttagtagagataggatttctccatgttgatcaggctggtcttgaactcccaaccacaggtgatcctcccaccttggcctcccaaagtgctgggattacaggtgtgagccactgcashtggccgagaattttttttttaaattgagacaaggtcttgcaatattgcccaggctgatcttgaagtcctgagctcgagtaatccttccacttcaccctcctgaagtgctgggattacaggcatcagccaccatacccagccagaggagaattttatatgctcttttggctttgaaattaagtcttgccctagcaagttttctggagcattatcacatggthnaatatatgtytttttttaaatgaccctaaagtcaattgnacaggttcagatntgggaacttcttgagcttgattcgaaactccagcacagaaatgaccttcttattctgagggatttgttcatgtattaaagtgggatttatggtagataaggt

SEQ ID NO: 32403 - DNA, 138 bp, Homo sapiens
ctagcaggaatctcggagttaagggagctcatggttatcctagaaatagtgataaaatggggaatggcttagttcttttctgagaataaggaagcaaccacatgtgtatccacttaattgacacatagtttgagcccc

SEQ ID NO: 32404 - DNA, 508 bp, Homo sapiens
  misc_feature 142: m=a or c
  misc_feature 146: w=a or t
  misc_feature 198: b=c or g or t
  misc_feature 210: n=a, g, c or t
  misc_feature 211: b=c or g or t
  misc_feature 212: n=a, g, c or t
  misc_feature 231: n=a, g, c or t
  misc_feature 300: b=c or g or t
  misc_feature 301: r=a or g
  misc_feature 508: m=a or c
taatttaatgcaaaatatccttttatgaatttcatgttaatattgtgaaatattaaaataattccacaatagttgagaaaaatgagcatttttttccatttttaaaaaatgcatagaaaagacaattttaaaatcctgggamccawatttatttagaagtagctgttagtaaaacattagaaaaggagtcaggccatbaggttatttatnbnaatctctaagcaattaggntgaagttattaagtcaagcctagaaaagctgcctccttgtaaggctttcatgacaatgtatagtaatcbrcagtgtccaattcttcgcactcctcaggaatatcactacctcaggttacggtacacaggctataattgatgatgatgttcagataactgaagacacaataaatgacattcagacatcaggacaattccctcatgttcttttctatgatggccacctgtaccagcaacgtgggtttcacccacacaacgatgaactgttctcttactm

SEQ ID NO: 32405 - DNA, 300 bp, Homo sapiens
  misc_feature 142: r=a or g
  misc_feature 262: h=a or c or t
  misc_feature 263: n=a, g, c or t
caatgagtgtaacaggaaattaaaatttgagaatttatgtaacacatatcatttaccataaaatagatatcagcggcctattttggaattgatatacagtataatggttagactaatctttccttctcttccatagtagggrtaattcatcatacctcagggaaatattcattgtatttcaagagaatagagaaacatcctttcctgtagctctagaatttgacgtgtggggctgctgtttcaggcatcctcatgataccghntctcgaaacttaagagtttcaataacaagtaagcact

SEQ ID NO: 32406 - DNA, 126 bp, Homo sapiens
cttcaaaatatgctacaaagctatagtaaccaaaacagtatggtactggcataaaaaccagactcatagaccattagaacataatagagagcccataaattaatccacatatctataagcaaccca

SEQ ID NO: 32407 - DNA, 222 bp, Homo sapiens
caaaagttgttttgaggtgtatttaaaagatgatatatggtgcttcaaaggaaactgggcattcaagttgtagaatgacaaagaggagttcaagcttatgggaagaatgaaaaattttttgattttctaatttgattctaaatgtcatgctgaaaatggaatctcttccgtgtcctctcccctactctgagggagcaaatggctttagtgctttgatgcgtc

SEQ ID NO: 32408 - DNA, 305 bp, Homo sapiens
  misc_feature 39: m=a or c
  misc_feature 117: m=a or c
  misc_feature 130: n=a, g, c or t
  misc_feature 137: y=c or t
  misc_feature 141: b=c or g or t
  misc_feature 145: d=a or g or t
  misc_feature 146: y=c or t
  misc_feature 154: y=c or t
  misc_feature 156: r=a or g
  misc_feature 162: r=a or g
  misc_feature 163: m=a or c
  misc_feature 169: k=g or t
  misc_feature 198: m=a or c
  misc_feature 284: m=a or c
caactgattggacgagacccaccagcattatggagaggmatccacttcctcaaaattcaccattcaccaattttaatgttagtctcatccaaaccaccctccaagttgacatataamattaaccatacantcgtcayaggbtggdycaaacttytrgactarmcatccktcttagcacctaacttgagacttaattamtgaaacaaaaacttcataattctcagggaaacagtgatttgtcttccatttataattgagtcacttctgtggggattcaggcaagmataagccaagagtggttctca

SEQ ID NO: 32409 - DNA, 414 bp, Homo sapiens
  misc_feature 371: m=a or c
  misc_feature 407: m=a or c
caatagaggaattccttcaccatcttgtccaagagtaaccgtcaaaccagtcttctcacagacatctaaacatcatctaatgatccgttgactcactgacttttctccttccacttcttttttatttttgctagagagagaagggtctcactcggtactcggttgcccaggcttgagtgcagtggcacagtcacagctttcagcagccttgacctcccaggctcaagtgatcctcacacctcagcctcccaagtagctaggactacaggcatgtgctaccacacctggctaataattaaaaaatgaatagtattatggaattatccaccatctctttttgtagagatgaggtcttgccatgttgcccaggmtggtgccaaactcctggactcaagccatcctcccamcttggcc

SEQ ID NO: 32410 - DNA, 287 bp, Homo sapiens
  misc_feature 148: r=a or g
attagcgcgacttggggttattcagtacacttcttgtttgcagatggtgaagagcgctcgcccggtagcagaaccgaacccgggcttctggtctcagctccagaagtatgaggaggccctccaggcccagtcctgcctgcagggagarccccccagccttagggttgggccctgaggcttgaagcttgaaggcctgctgcctggaggaaggatgtccctgcactgatacagaagctgtttctggcaaagcctgccgtgtcttacatttgtctctctatccggaactc

SEQ ID NO: 32411 - DNA, 502 bp, Homo sapiens
  misc_feature 119: v=a or c or g
  misc_feature 146: h=a or c or t
  misc_feature 157: s=g or c
  misc_feature 379: n=a, g, c or t
  misc_feature 380: s=g or c
  misc_feature 418: n=a, g, c or t
tttaactttgattatgttctgttgtcctggtaacttcatatgaatttccatggtctgttaaactgttctttctttatttcaggcatttgctttttcttctgatctagatcgttatttcvttgatggcagagactgtcatcttttthcttgatttcgsccatagcctgaccatggccttgagctcagcgctgagcttgtagggctagagcacctttggtttgggcatccaaagagagcttggctggcacaactcatttttttcagcaaaggaagtaacacttcactcagttaaggttaatcagataaggcagtggtagggctagggggagcactagttcatccagcctcattgttctatgctaaattataggtgtctganstaaatttcaggggagaagtctggtagatcctccatgcntggcaggaaagtgtgctggagggtctagaagtcatgccccagaccttcttttcctctttgcctctgtcacacacttcttgatac

SEQ ID NO: 32412 - DNA, 357 bp, Homo sapiens
  misc_feature 138: v=a or c or g
  misc_feature 144: y=c or t
  misc_feature 313: w=a or t
  misc_feature 314: v=a or c or g
  misc_feature 335: b=c or g or t
cgtagactaaagtctgatttattctagctgattttacttgtcttgtgggttgctggttcccagaatgggttaaattagattgaaaaaggagtctaggactctaccctgcccccaccagagtcccagagagttccaggvaattgyagctgtagcaggatataaatgcttgctgcttggacaactggggcaaatccagatttcttaattctttttttttctcgttttgctcttgttgcccaggctggagtgcagtggcgagatctcggctcactgcaacctctgcctgctgggttcaagtgattctcctgcttcwvgcctccccagtagctgggatbataggcacctgccatcacgccc

SEQ ID NO: 32413 - DNA, 440 bp, Homo sapiens
  misc_feature 47: n=a, g, c or t
  misc_feature 156: k=g or t
  misc_feature 160: r=a or g
ttgtagtatgttatacaatagaatctagattattggatttgttaggncttttctgcttcattaaagttcatcttaagtgttttttccctaagatatatcacactgtgatgatgtgatgttttattttgtttttgttttgagatggagtctttctckgttrgcccaggctggagtgcagtggcatgacattggctcactgcaatctccgccttccaaattcaagcaattctcctgccacagcctcccgagtagctgggactacaggtgcacaccactacacccagctaatttttgtatttttagcagagatgttgtttttccatgttggccaggctggtcttgaacttctgacctcaagtgatccacctgcctcagcctcccaaagtgctgggattacaggcatgagccaccgcgcctagcctgttttttggtttttaatc

SEQ ID NO: 32414 - DNA, 377 bp, Homo sapiens
  misc_feature 144: r=a or g
  misc_feature 235: r=a or g
  misc_feature 236: n=a, g, c or t
  misc_feature 261: n=a, g, c or t
  misc_feature 335: d=a or g or t
cattcagtttgaagaattttaaaatttccatcttgatttcgcttttgaaccaaagcaggttttgaacctgctctttcaggagcaggttatttaatttccatgtatttgcatggctttgaaggttccttttgaagttgatttccrgttttattccactgtggtctgagagagtgcttgatataatttcagttttcttagatttattgaggctcactttatggcctatcatggagarngttccatgccctgttgaatagaatntgtattctgtggttgttggatgaaatgttctgtatatatctgttaagtccatttgttccaaggtatagtttaadtctattgtttctttgttgactttctgtcttgatgacccatta

SEQ ID NO: 32415 - DNA, 79 bp, Homo sapiens
aaaagagagcccggagccagcgtgggaggccgctgccgtcgcgcgccttggtttttctgttcctttttttttttttttt

SEQ ID NO: 32416 - DNA, 390 bp, Homo sapiens
  misc_feature 122: d=a or g or t
  misc_feature 126: r=a or g
  misc_feature 134: k=g or t
  misc_feature 144: m=a or c
  misc_feature 154: m=a or c
  misc_feature 196: k=g or t
  misc_feature 242: w=a or t
  misc_feature 243: v=a or c or g
  misc_feature 267: k=g or t
  misc_feature 294: s=g or c
  misc_feature 303: w=a or t
  misc_feature 304: y=c or t
  misc_feature 355: m=a or c
cttaatgtcaccaaactatacagtaaaaaatggttaaagtggtaagttttatgttacatatattttaccataataaaaataagattattaaagtttttactgtgtcttaaaaaaaaaaagadtaarggcactgkccctctaaamccgcataaamatttttttgcatacaggaaactcaacaatgattgtatcctgkgttgagatttcccatatgtttcccccattcacacaggtgatgtgtwvatactaatgctatgttaatgtttkcttttaaatagatatattttagttgascaggttgawytaaagcacaggtggatctgtgggtgataaaagtggtaggtgtggaaactgmctggggtctaaccagcctgaatgtgtagtattccc

SEQ ID NO: 32417 - DNA, 229 bp, Homo sapiens
  misc_feature 221: n=a, g, c or t
atggccgctcccagctgggacgtgagtctctggattaggcaggcagaggcagttatgggcttctgcagtggcgagaaaggaagcgcctgaagggtcgtgaggctggggcgggacccggcaccgctggggcggccaaggccgtgaggacgccaatggcgagcagcgtggacgaggaggcgctgcaccagctgtacctgtgggtagacaacatccctctgtcncggccgct

SEQ ID NO: 32418 - DNA, 273 bp, Homo sapiens
  misc_feature 131: b=c or g or t
  misc_feature 137: k=g or t
  misc_feature 142: h=a or c or t
  misc_feature 147: k=g or t
tgtaggaaaataaggttataggcttgtataaacataaatatacttaacaaaagcaattctacggttatagctatagaatacaccttgtctttcctctcaataaatgtcatgaaccactggatggagtgtcbtagttkgttthctttkccttataacaaaacacccaaaactgggtaatttataaagaaaaggaatttatttcttacagttatggaggctgagaggtccaaggttgaggggctgcatctgttgatagccttcttggtggtaggg

SEQ ID NO: 32419 - DNA, 276 bp, Homo sapiens
  misc_feature 144: n=a, g, c or t
ctacttcctcgccagagaaactgctgtcttccccggcggtagggaagggttaatgccaccgagtatccagacccgctgaagcctagagggccttgtaccggctcaccgcgtggctgtcgctgtctcgtgtcccccagtgggggnaaggcgtcgcactgccgcgtctgttctgcgtggctgtcgggcggcgtttggtcccgggagcctcgccggagaaacggagacctaagaagtgacttgctcagggtcacatagctcagcagtggcggccgctta

SEQ ID NO: 32420 - DNA, 441 bp, Homo sapiens
  misc_feature 325: b=c or g or t
  misc_feature 326: h=a or c or t
  misc_feature 327: n=a, g, c or t
taaagaaaagaattttcaacccagaatttcatatccagccaaactaaacttcataagtgaaggagaaataaaatacagacaagcaaatgctgagagattttgtcaccaccaggcctgccctaaaagaactcctgaaggaagcactaaacatggaaaggaacaaccggtaccagccactgcaaaaacatgccaaattgtaaagaccatcgagactaggaagaaacttcatcaactaacaagcaaaataaccagctaacatcataatgacaggatcaaattcacacataaccatattaaccttaaatgtaaatggactaaatgttcbhnttaaaagacccagagtggcaaattggataaagagtcaagacccatcagtctgctgtattcaggaaacccatctcacatgcaaagatgcacataggctcaaagtaaagggatgga

SEQ ID NO: 32421 - DNA, 270 bp, Homo sapiens
  misc_feature 133: r=a or g
  misc_feature 148: v=a or c or g
  misc_feature 149: r=a or g
caaggaaaattttaaaatttgagcatttccgagtctttgccctcaaaatcttcatcttgtgtttgcccattctaagtgattagattatggtcctcactagaccccagccagggctccctggctctcacactaraagatacacattggvraaaatccagacttcacaatctcaaaaatactcccaactttgctccatcccctacctgcaccccgagactctagtgagattttttgtaaatagtgttctccattaactttaagccatcagtt

SEQ ID NO: 32422 - DNA, 230 bp, Homo sapiens
  misc_feature 116: k=g or t
  misc_feature 117: h=a or c or t
taaggtatcgattttagatctttcctgctttatcttgtgagcatttagtgctataaatttccctctacacactgctttaaatgtgtcccagagattctggtatgttgtgtctttgkhctcattggtttcaaagaacatctttatttctgccttcatttcattatttacccagtgtccattcaggagcatgttgttcagtttccatgtagttgtgcggttttgagtgagtc

SEQ ID NO: 32423 - DNA, 328 bp, Homo sapiens
atagatatatttgtttttgcatatatgcccagtagtggtatagatcattaccagtggatcatatggtagttgtatttttaacttttgtttatttttcattttttaaaatggggtcttgctgtgttattcaggctggtctcagactcctgggctcaagcagtcctgcacctcagcctcctgagtagctgggactacaggcacacaccaccgtgcctggctatagttttagatttttgaggaacatccatactgttttccatatggctatactaattagcattcctaccagccatatataagagttcccccttttccatgttctcagcac

SEQ ID NO: 32424 - DNA, 347 bp, Homo sapiens
  misc_feature 189: n=a, g, c or t
  misc_feature 190: n=a, g, c or t
  misc_feature 268: n=a, g, c or t
  misc_feature 285: m=a or c
acttggtgtctgcagcttcaagaaccaggttcaattcccctccaagtgcacctgggctgcctcctcttaatcttgctgcaccgcagcagcccctccccaacccggtaaaatgtgggcgataattcctttcttacaaggcccttcacagatacctgctggtctctcccacttggcaaaggaaacacttgnngttaataagtctcagaaaagttatgtgaaagttaaaagtaaaactgacagcagctgaaggatgggggggtgggaggtngtgacggtggaggagamcccaccaccactgccacccaagtagggagtgaggagcaccaggagcacaggatgctacttct

SEQ ID NO: 32425 - DNA, 164 bp, Homo sapiens
attctcttaaaacaagattagaagactggataagatcttacagaaaaggtttacccaattatcgtggatattgaatgtatagtgcatagtaggctcctactacagcaagtccttgaactcttgggcctgtggaggatatagatatatgtagagagggggtactt

SEQ ID NO: 32426 - DNA, 170 bp, Homo sapiens
agagcgcagagccggacagagcagaagaaccctcttggactggacgatttgggaattcaaaacttgggacaaactgtcagccttgcccctgctgtggaggcagcctcaatgctgaaaatggagcctctgaacagcacgcaccccggcaccgccgcctccagcagccccct

SEQ ID NO: 32427 - DNA, 94 bp, Homo sapiens
atgacggtgccggtccgcggcttctcgctgctccgcggccgccttggccgagcgccggcgttgggcagaagcacagcaccctccgtaaggggcg

SEQ ID NO: 32428 - DNA, 256 bp, Homo sapiens
  misc_feature 145: r=a or g
  misc_feature 148: m=a or c
  misc_feature 149: y=c or t
  misc_feature 153: w=a or t
  misc_feature 158: w=a or t
tattattaaactttttattttgaggttagtgtggattgaaatacacttccaacaattaacacaaaggtcccctgtgtcctttacccagttttccacaatggtaacatcttacaaaactggagtacaatgtcactcacatccaggrtamyaatwatggwtacaatcaagatacagaatatttctattacaaaggtcttgtgttgccttcttatagcaacacctactttcttcctactccttccctcatccattccac

SEQ ID NO: 32429 - DNA, 352 bp, Homo sapiens
  misc_feature 149: m=a or c
  misc_feature 151: s=g or c
  misc_feature 153: y=c or t
  misc_feature 161: n=a, g, c or t
  misc_feature 162: b=c or g or t
  misc_feature 163: d=a or g or t
  misc_feature 164: n=a, g, c or t
acaaaaaaacaagacagatttggagatataagtgacattatgtttttcagaaataagaaccggaggtacaaatttccattggtacttagtactttaatatgaaaatatgcaatgaagaaagcatcttgcagccgggcacggtggctcamgscyggtaatcnbdncactttgggaggccaaaaggggcggatcacctgaggtcgggagttcaagaccagcctgaccaagatggagaagccccatctctactaaaaatacaaaattagccaggggtggtggcgcatgcctgtaatcccagctactgaggaggctgaggcaggagaatcgcttgaacctgggaggcgaaggttgc

SEQ ID NO: 32430 - DNA, 168 bp, Homo sapiens
  misc_feature 47: n=a, g, c or t
  misc_feature 160: y=c or t
  misc_feature 162: s=g or c
ttttgtcctctgttcttctgtttatgtctccctctacttatcctagngctagtggctgctccccaaatttaatccttattcctgtgccctttctattccctctctgcagctaggtctccattcccaatccttaatgctcaggattcccaatttaaaattycsagtcgc

SEQ ID NO: 32431 - DNA, 474 bp, Homo sapiens
  misc_feature 48: k=g or t
  misc_feature 70: n=a, g, c or t
  misc_feature 149: r=a or g
  misc_feature 333: h=a or c or t
  misc_feature 334: r=a or g
  misc_feature 351: w=a or t
  misc_feature 474: y=c or t
agagaagataaaatactggcaaaccgaatccagcagcacatcaaaaakttatctacccatgatcaagtgngcttcatccctgggatgcaaggctggttcaacatatgcaaatcaataaatgtaatccagcatataaacagaaccaaagrccaaacccacatgattatctcaatagatgcagaaaaggcctttgacaaaattcaacagcccttcatgctaaaaactcccaataaattaggtattgatgggatgtatctcaaaataataagagctatttatgacaaacccacagccaatatcatactgaatggacaaaaactggaagcattacahracagggatgccctctcwcatcactcctattcaacatagtgttggaagttctggccagggcaatcagacaggagaaagaaagaaagggtattcaattaggaaaagaggaagtcaaattgtcctgtttgcagatgacatgay

SEQ ID NO: 32432 - DNA, 323 bp, Homo sapiens
taaaaagaagaaaatatcccttgataccaatagtcccttaaactattgtcttgtatccctttgcttactgcatttgccaaattattggccagaaaacactagctcctcaagatattactaagtattgtgtgaaaaatcagtggtttagtaaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgctc

SEQ ID NO: 32433 - DNA, 62 bp, Homo sapiens
  misc_feature 7: y=c or t
  misc_feature 8: k=g or t
  misc_feature 16: y=c or t
  misc_feature 24: s=g or c
  misc_feature 28: v=a or c or g
  misc_feature 30: k=g or t
  misc_feature 42: k=g or t
  misc_feature 47: m=a or c
atctatykttcattgygggagagsccavgktgtcctgcttakctgamattaagcccaaatcc

SEQ ID NO: 32434 - DNA, 460 bp, Homo sapiens
  misc_feature 146: s=g or c
  misc_feature 152: s=g or c
  misc_feature 154: k=g or t
  misc_feature 289: h=a or c or t
  misc_feature 290: y=c or t
  misc_feature 344: n=a, g, c or t
tatctggaagctctgaaccctgtacttgtgagtttttatggaggcttcattacataggcatgattgattaaaccattggccgttggtgatcaacttaagctttagtatctctcccttccctggaaattaaggatgggctgaaagtsccagtscktctaatcagtcatgccttggtcttcctggtgaccagctcctgtccgaagctacctaggagctgccagccatcagtcaattcgtgagcatacgaaaagacattactggttgggtgtggtggctcacacctataathycagcaatttgtgaggccgaggcggatggatcacctgaggttgggagttctagancattctggccaacatggtgaaacccgtctctgctgaaaatacaaaaaattagccgggtgtggtggtatgcgcctgtaatcccagctacttgggaggctgaggcagaagaattgttt

SEQ ID NO: 32435 - DNA, 372 bp, Homo sapiens
  misc_feature 172: n=a, g, c or t
  misc_feature 173: m=a or c
caaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaaccgagcacaaactccacgaagnmaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccggc

SEQ ID NO: 32436 - DNA, 491 bp, Homo sapiens
  misc_feature 148: k=g or t
  misc_feature 154: r=a or g
  misc_feature 432: n=a, g, c or t
aatgggggcccaggagggtcttcctctcccctttcctgctctgaaagtcccttctaaagacgtcttccacaggctggctgtttttctcagggaaactgtttcacctgaaatgcatctgtctcctgctgttcttggtgtttatactttkgtttcrgtgatcaggtattccttttaggtatatttttctgtgcaggagactgtcttggacaatggatatatgtattagtagcttggtaactgccacagtagaataaatatgtgaaatgttctcatcttgttgacgggtagctggctctttttctcgttggtatcacgttaggatacacacatttaaacacacatttgcatgtatgcatgggcataaaggaaaaacaaatactgattggggaagagacttgtctaagttcttatagaaaactagtatttttaccnttaagtacttccagtcactcaaattagagcaactaattattcctcatatgcatcgggga

SEQ ID NO: 32437 - DNA, 493 bp, Homo sapiens
  misc_feature 365: w=a or t
  misc_feature 367: w=a or t
  misc_feature 448: m=a or c
  misc_feature 449: b=c or g or t
  misc_feature 450: w=a or t
ctaaaaaactgctctgtttaagacatggtcaagaaaatgagaagacaagccacagactgggagaaaatattgcaaaagcatatttgataaaagattgttatctaaagtatacaaagaacttttaaaagtcaacaatacaaatatgaccagctaattgaaaaatgggcaaaagatctggacagacacctcacggaagtcttcttacatataggtggcacataaacgtatggaaaagtgttcaacatcatgtcattcaggaattgtaaatttaaacagtgagataatggcaaaagcaacagaactctcattcactgttggtgagaatgcaaaatggtacggttaccttgggaggacagtctggcagwtwcttagaaagtgaaacattcttactgtatgatccagcagttctgcttcttggtatttacccaataagttgaacgcttaaatmbwtgcaaaaatctgcatatggatgtctgtagcagctttattcata

SEQ ID NO: 32438 - DNA, 453 bp, Homo sapiens
  misc_feature 319: h=a or c or t
  misc_feature 397: w=a or t
  misc_feature 398: h=a or c or t
aaagaacgtgtcattcacgctgcctccctttgtcctgagctgcaggtaccagcacatctgggcactttctccatggtccgctgtcctaatcctgactatttcagcacccagggagcaagccaagaacaaaaacacctatcatccatgcccggcattagaaaatctcattgttggtgagaatgatggtttccagcttcatccgtgtccctacaaaggacatgaactcatcgttttctatggctgcgtagtattccatggtgtatatgtgccacattttcttaatccagtctatcattgatggacatttgggttggtttchagtctttgctattgtgaatagtgctgcaataaacatacgtgagcatgtgtctttatggaagcatgatttataatcctwhgggtatatacccagtaatgggattgctggatcaaatggtatttctagttcagcaa

SEQ ID NO: 32439 - DNA, 284 bp, Homo sapiens
tattttttggttgttttatggtcttctcttccttctttccttccttcctgtctttcttttagtgaagatgattttctctggtggtatgtttgaatttcttgctttttattttttgagtgtccattgtatgctttttgatttgaggttatcatgagacttgcaaataatatcttataacccattattataaactgattacaacactgattgcataaacaaataaaaaactaacaagcaaagagaaaactaataaaaattctagactttaactttgtcccctagcc

SEQ ID NO: 32440 - DNA, 115 bp, Homo sapiens
ctgggaatttcccttccttctctcatgttttaaatcgtgtttcctggttcctgttttctactctttcttgatttattctcttgtctttgatgtatcacatcctctaccaccctaa

SEQ ID NO: 32441 - DNA, 414 bp, Homo sapiens
  misc_feature 286: n=a, g, c or t
taaatgattcaacgtttatgtaaatgtcaagtttttgtgaatagggatttatgtctaagacagaaaaatctactgaactagttcttactgtggaactaattgtggataaaacattcgttatcatctaaattttaaatgaatgacaacagttatggacacatgcaaaaggtatcagacatagaaaatattgttgggggaaatttctgtgtggtgctaatttcttgtaagggttgtacagatagtgcttaactcaaaaagtgagagtgtggtcattgccaaatagggntttgctcagagttccttctctaggactgtatgcagaaagcatacacacacacatacgcacacagaaaaatatgatttttatatcatattcatgaaaatgtgccatatccaattataacacacactctt

SEQ ID NO: 32442 - DNA, 100 bp, Homo sapiens
acggcttctgggagctgctgcttcgctgtgagaagtatccgcgacgagctatccgggaaagggccgaatgcgatcaaacctaatccgcgagacttgctaa

SEQ ID NO: 32443 - DNA, 156 bp, Homo sapiens
attagaggttgaaagtgcaccaacatattaggtgcattttatggcccaggaagtgcattggcattttatatacaatgcagttcaatttcaaaaatcctatttattaagtgttactaggtgatatgatcgtccttagaagatgaagaatccagccgc

SEQ ID NO: 32444 - DNA, 499 bp, Homo sapiens
  misc_feature 167: n=a, g, c or t
  misc_feature 198: n=a, g, c or t
  misc_feature 348: r=a or g
  misc_feature 349: n=a, g, c or t
  misc_feature 350: d=a or g or t
ctgaaactttgctaactatgaaaaataatttaggagccattagttttagttttgaattatgtaatctaaaaagttttcagtttttagagttattctcttgattcctcttatggtttaaggtcttaggatggtgcttatcaaactgaagcgtatctctctgaggtatnaactttactcagttgggggaaaaataactgntaattatgttaaacattttaataaaatagatgactgtattgtggatgggatataagtatttcaaaaaatctgagtgcctataaaataaaacttcaaggacattttagaccattccatgggctgcctcagattgtgccttcaaatcctctrndatcatacatttactctcatattctaagttgactgtctctgtcatgaagattatagtcgtaaaaactgaagcagcattatttaagccaaggtatgttaaaaagactgtttctttaaaaattatctttttcttggtttctgtgcctagata

SEQ ID NO: 32445 - DNA, 367 bp, Homo sapiens
aaaatggattaaaatggggaaaaaagccccacaagatttcagtgaatatttgtttgatgttggagtggctaagaattacttaagcaagagaaaacaatgaaaggatcaataagagaaaataatgttagatcttaattatacacaaatttaaaaagcttcaatgtattgaaaattaagacaattgggttaaaaaattggctgatgaaggcatgatgtctttaatgtatgaaaaacttttctctttaatcaataaggcacactaaaaagcagtattattaacaaaaatattaatttttaaaagtataggacctgggcacactgtctcatacctttaattccagcactttgggaggctgaggagggagac

SEQ ID NO: 32446 - DNA, 489 bp, Homo sapiens
  misc_feature 376: m=a or c
  misc_feature 377: n=a, g, c or t
ttatttatttatttatatttgagacggggtcttgctatgtttcctcctggaatcaagccatccttccactccctagtagctggaagtataggcgcacgccaccatgtctggctaatttttgtattttctgtagagatacaaaaaatctctacactgtgtcgcctaggctggtccccaactcctgagctcaagcaatccacctaccgtggtgttccaaaatgctgggattatagctgtgagcccttgcgcccagccagttatattgtttttagattgtagtttcttttttctatctagaccaggcagagcaatatactgagaccctgtctccacaaacgaacgaacaataatagccaggtgtggtggcgtgcacctmnagtcccagctgcttgagaggctgaggcaggaggattgcttgaccccaggaatttgaggctgcagtgagctgtgattgtgccactgcatccccacctgggtgacagaataaga

SEQ ID NO: 32447 - DNA, 173 bp, Homo sapiens
atttgggttatgaagctcttgttctcttatccttgcaggagaaagaattgtgccatgaaaaatggaaaactcctgagaagctgttccagcgtcaggagagcagcagacaagctggactggggaagattcttcctgcaagacctgcagagtgtatgacacataaccagcacccc

SEQ ID NO: 32448 - DNA, 96 bp, Homo sapiens
  misc_feature 89: k=g or t
gacgctgcccttccgcagcgatggcatcccggctctgtggaggggccctctggtatgtgtgtccctgtccttctggggcgtggatggtkcctggga

SEQ ID NO: 32449 - DNA, 166 bp, Homo sapiens
  misc_feature 125: s=g or c
  misc_feature 136: w=a or t
tctacagccaattcacctcctgggcccttacttactccagcacttctgcctcatcgtatcttatctgatgtgactcaaggtctacctcatgctcattctgcctgtttggaagagcttaagcgcastatgagttctwatcggtactttgaaactcagcaccagtctt

SEQ ID NO: 32450 - DNA, 468 bp, Homo sapiens
  misc_feature 135: r=a or g
  misc_feature 136: r=a or g
  misc_feature 205: k=g or t
tattggaggaataagttctgttgtagtgctctatagctggtcacatggaaataaccataatttatggtatattttcaaaaagctagaagagaggattttgaatgttgtcaacacaaaagtatgataaatgtttgrrgtgtttgaaatgctaattaccctgatttgatcattacgcattgtacacctgtatcaaaatatcactctktttccataaatatgtacaattattgcatgccaactaacaataaaaggacaagataaagattcaaaaaataggaagaaatatcatttttctgatacaatttcttctcggtgtgcccatgttgttttatgattgcaaagcgttcttttaagtgcttttaaagtattgttttcatgcttcttaaaattgcttccagaagtaatgtcaaactcattcacctatagtttatgagatctatcttcctttaaaaaactagtacacggccc

SEQ ID NO: 32451 - DNA, 470 bp, Homo sapiens
cctcacatttagacaatgtggtagtgtgctggttcagaaggagcccagctatgcatggctaagggcaaatccctgaatggagaaggaaattgaaaaatgttgactaacctgagaaacagtctttggaaaagggtgaatctcaggttctcatgcaggacaatttaggaaaaagagagcaagccaggagaaggctgagaacttattccccattagtcaaaaatctgctttaagtcaagatcctgcaatggcctttcacaacaagcccctgaaaatcagcagaacaaagactgggcctggtgagtgagtgcctacgcagagttcttgctgccgtgattcagtgcaagttagaaacctgtgctcttctttagcctggggaaaaaccaaagtcagcaaacccagctcaactcagcaaactttcgtcgcctgtatgctaactataaggcatgttgctaggtactgtggaaattgta

SEQ ID NO: 32452 - DNA, 403 bp, Homo sapiens
tatatgtctgttcttgttttgagaatttttgtgaccatattttcaagtctatatagtctgaatcatttttatggctgtatagtattctgttgtattctattgtatggatgtagagtgatttaacatcttttgttgggaatttattgtcataatcttacacgtatgtctttgcacatttgtctgattattttatttgtataagttggcagaagtgaaattgctgggttaaagggaattgtctgctagaaaggctagtttatactctaaccagcagtgtgtgagagtatctagtttcccacacctttgccaacaatgaattttacaattatttttaacctttgaaagtctgacagatgaaaaataccttaatattgtcttagtatatttttaaattacttggtga

SEQ ID NO: 32453 - DNA, 278 bp, Homo sapiens
accaacctaatagtttgcttagtgtttttatcatgaaaaggtattagatttttaaaatgttttttctgtctgtgaggttatcatgtgttattttgctttgttgtattattgtggtgtataattttttttgagacggggtcttgctctgtcgcccaggctggagtgcagtggcgcgatctctgctcactgcaagctccacatctcgggttcacgccattctcctgcctcagcctcccgagtagctgggactacaggcgcccgccaccacgcccggctct

SEQ ID NO: 32454 - DNA, 84 bp, Homo sapiens
acatctgcattccgataggaaagggaaacagcagaaacacaatacccatctgagagctacgcttagagaggactctgggcttcc

SEQ ID NO: 32455 - DNA, 252 bp, Homo sapiens
  misc_feature 135: s=g or c
  misc_feature 154: s=g or c
  misc_feature 171: r=a or g
  misc_feature 187: r=a or g
  misc_feature 193: r=a or g
  misc_feature 197: m=a or c
  misc_feature 198: k=g or t
  misc_feature 206: r=a or g
  misc_feature 234: k=g or t
  misc_feature 235: s=g or c
  misc_feature 247: n=a, g, c or t
  misc_feature 248: n=a, g, c or t
cctttttaattttttttccatgtgttcacttccgggtccggcgtcgatccggatgcccgaggcagaaggatgtttgacctccggataagcgaggcgctgctgtgcattcattccgggctgcatcggtggcgacascagaggctcgggcggcgastctccggccagcggcgrcggtaggaggcaccarcggcartgcmkggaccgartccgagcagcgctgcgttacctctctckstcgctccttccnncctt

SEQ ID NO: 32456 - DNA, 225 bp, Homo sapiens
aaaatctagtattaccgagttagagataattttagatcatcccttatactgttacgtgaattcctgtgaacatgaatattactgattctcaagttccagtatacagaagaataacttgtcattgcctgtcctggtgtacccagatgttccatgatggacgttttatcccataagacgtctccctcctgatagatgtccgtatatgcagattaaactaccaacaaa

SEQ ID NO: 32457 - DNA, 483 bp, Homo sapiens
  misc_feature 453: m=a or c
accatctttaacatttcttgtaagacagatctagtagtggtaaattctcttagcttttgtttgtcagaaaaagactatctctccttcatacttgaaggatatttctgctgtttgctggataaagtatttgaggatagcagggttttttggggttttttttctttcagcactttgaaaatatcattccacttcctcctgacttacggtttccattgagaagtgtgttgccaactgaagtggagtttctttgtatgttatatcctccttttttcttgctgcttttagtatcctctttttgtccttgacctttgagagttttattattatatgccttgggtgtagttttatttgggtcaaatctgtttagtgttttctgaccttcctctacctggatatttttctcatattttggaaagttttctgttattatttattgagtaagcttttttctamccctcactcttgctcaactttctcttgaac

SEQ ID NO: 32458 - DNA, 403 bp, Homo sapiens
  misc_feature 136: s=g or c
  misc_feature 159: r=a or g
  misc_feature 292: v=a or c or g
  misc_feature 294: m=a or c
ctaaaataaagtcaattgaactgttgcgcagaaagatagctcagttaattgagtcctgtgggaagccgtcatctttggcttcaaatagtgcacatcgtcgctctgtagggcaggcatcaaagggaacttcaaaagstacctctgaaggtattcaagaartcaacgtgtcactcactggtcttggccattccacaggtactcttcagaaacctccgaatgttggtggtattactggtaatagacagcttactcatcaacaaatatatccacactttgcagatggcagtaatavgmaaaccaaaagcagagtggccaggaaggctcatgttgccacgccagtgttaatccccaaaggggctgtgttgagggttcttaattcctctgagaatgcccacatcataga

SEQ ID NO: 32459 - DNA, 181 bp, Homo sapiens
  misc_feature 175: b=c or g or t
  misc_feature 176: m=a or c
tgtgtatgtgtggttctatgcagttctgtcccacgtatggatgcatataaccaccaccataatcaagatacagattgtttcatcaccacaaaggaactctctcatgtacctctttagttatacccttctgcccccacttctagtcacctggcaaccatgaagctgttctccaccbmcatgt

SEQ ID NO: 32460 - DNA, 400 bp, Homo sapiens
  misc_feature 30: s=g or c
  misc_feature 151: m=a or c
gagctggagctgaagcgcaggctgcggggscggagtcgggagtgcaggcctgagtgttccttccagcatgtcggagggggagtcccagacagtacttagcagtggctcagacccaaaggtagaatcctcatcttcagctcctgggcttgamatcagtgtcacctcctgtgacctccacaacctcagctgcttccccagaggaagaagaagaaagtgaagatgagtctgagattttggaagaatcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcagga

SEQ ID NO: 32461 - DNA, 483 bp, Homo sapiens
  misc_feature 137: r=a or g
  misc_feature 138: r=a or g
  misc_feature 142: y=c or t
  misc_feature 147: y=c or t
  misc_feature 150: y=c or t
  misc_feature 162: r=a or g
tatggtgcaaggtatatgatgtgtgcaaatatgtccacagaaataaatacatagtaggtatgtggaatgtaaatttaagtcaatcgttccgcatagtttagaaatgtaaggggctttttcatattgttaactgagtrrgatyagttyccyttaatgcctgtraggctgcagggtttgttctcacttgcatgcacacactaagcccaaatatttctgttcattcattgtcagatcaggatatgaaaataaaatttttctgttagttttttttgtattgagattccaaagatggtaatatttttataatattcatgtatatatggaaatactttttttgacggctagggtatcttttgtgtttctgtaggacctagatgtgaaggctggtggaggctgtgtaatgaccattggagaaatgctacgatcttttctcacaaaactggagtggttttctaccttgtttccaagaattccagttccagc

SEQ ID NO: 32462 - DNA, 431 bp, Homo sapiens
  misc_feature 154: y=c or t
  misc_feature 167: y=c or t
  misc_feature 179: m=a or c
agctggcggcattgaggcggacgcgtctagaggtccgtctgaccgcggcgtcgggacctggtttccgggcatgagctgagagcaccacgccgaggccacgagacattgatggaagcagaaaccaaaactcttcccctggagaatgcatccatcyttcagagggctcyctgcaggaaggmcaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagta

SEQ ID NO: 32463 - DNA, 302 bp, Homo sapiens
tcatagtcactttccaagtttatgacccagagcaatctgaccttggtagcttgtctccctcattaaattctctgacttcataatcagctcacattcccttcctctctttccctctctttttaaatatctgtaaaacattcaaattgatccacgtagatttatcttgcttttaggccacactctgagatgtgtaatccggttgctcacacatttagaggagtccatgagcatcacgccatgctactctccactggtttgaacatcttaggcactcaggcattccgttacgaagatgggcagct

SEQ ID NO: 32464 - DNA, 473 bp, Homo sapiens
  misc_feature 150: r=a or g
  misc_feature 161: r=a or g
  misc_feature 162: r=a or g
  misc_feature 212: k=g or t
  misc_feature 214: k=g or t
  misc_feature 234: d=a or g or t
aggacatttgatatcgaggagaaaaacaaaataacatctgctcctatgtagatctgatgttagtacatagtagaaaacctcaagagatgattgatatttggtctcagttgcagagtgctcatttaaaatgctaaaatagatacaaactcrattttgcaatrraaaggtgtattttgaatagttcccatgttgtgttctcacattagagtaaktkctgtattaaaccatgaaaadtgcctttatgagtgatacccatttggggcctctaaacccttcaatttggtactcacgtgaagagggaaagcggaagatggtaatttttttttacggatgatatggcaggatgattggttctgatcttaccggctagtggtcatttttaaaaaacttgtaccctcttatctgaaatcctgtttctggaatttggccattttaagtgattttgtttgccctcttctataatattcctactt

SEQ ID NO: 32465 - DNA, 262 bp, Homo sapiens
  misc_feature 144: s=g or c
  misc_feature 169: n=a, g, c or t
actactgcgcaggtctgcgtggaacctggtggggtgcgcctgcgtcttggagaactagggttgtcgctcgtggagacttttgaacaatttttaaagccaacatttaccacttattggacgcttaccgtatactggccaccatgstaagcatgcattaactgcattcatncaacgtgtatttatgggggcatttactgtatataccgctgtatgcttcgtatataccggtcctgtccaacaaacgtcggaggcacgcatcccc

SEQ ID NO: 32466 - DNA, 171 bp, Homo sapiens
  misc_feature 28: s=g or c
gcgcgacgttttttgttgacccggaaasgattatccggagccaaggtccgctcggaggcatggctattgcaccttgggagaagcctttaatcggttagacttctcaagtgcaattcaagatatccgaaggttcaattatgtggtcaaaatgatgaatattccccaccttcc

SEQ ID NO: 32467 - DNA, 111 bp, Homo sapiens
  misc_feature 23: r=a or g
atattctgttttgccatagctargacacaggtacagaggtaacattttttcaatgagatttttctgcccttggtttaggctgaagaaatgtcaacaattgggagttttgaa

SEQ ID NO: 32468 - DNA, 231 bp, Homo sapiens
  misc_feature 24: y=c or t
  misc_feature 130: r=a or g
  misc_feature 138: s=g or c
  misc_feature 140: w=a or t
atgaatggaatcatatatatggaytttgtatctggcgttttcatttaccataatgtttccagggtttttccatgatgtagcatgttttagtacttagtttttatgacaaactattagtccattgcatggrtatgccgsawttttgtttgcccattcacatgttgatggacatttggattgcttctgccttttggtcattgtaaacaaggctgttatgactatttgtgtacc

SEQ ID NO: 32469 - DNA, 237 bp, Homo sapiens
gatatgtatcaccttaaacatttttccttgtgctagaaacattcctcacagaactgttaaagctaacttgtagtctgttatccctgtcgctcactgatagttcacattttttactttataatgtctccttaggtttaaaataacattttaaaaaatttttgtaagtatcaggcactgttaggtgctagattttaaaagtaaaaaagaaaaaaaaataagagtctctgtccttgggtt

SEQ ID NO: 32470 - DNA, 231 bp, Homo sapiens
  misc_feature 209: s=g or c
ctacagtaacctccttggtagattttgtattgcttttttcagactgtagacgtctgcaaaaaaattcacaagagaatagtagagtttgtaacagaattattttttgggaaatctctctgcgttacttacctttccttaggagaccctcttgtgattctgcagtacctatcatggccatttctctcacaggaggctcctgggtcccattsatacactttttttttttttttt

SEQ ID NO: 32471 - DNA, 443 bp, Homo sapiens
  misc_feature 71: v=a or c or g
  misc_feature 132: w=a or t
  misc_feature 162: r=a or g
  misc_feature 314: n=a, g, c or t
  misc_feature 317: w=a or t
  misc_feature 370: h=a or c or t
  misc_feature 371: d=a or g or t
taagaactagatacgtgttttctatctgaacttaagataacacataaatatccctgagctattttcttggvcttttcagttgagagtgttgtttgcactaaaagtattctctaccatctcatccaacattgwcatgtgaagccctaagttgaagaaatggartacttgtgggtggtattcagattccttggctggggaaaaaaattgtttttctattatgttaacaagaagaaatattaaatattaaaaataataataaatttactgaagcaaggaagtggtggggagactggatggctttactttatgagaancgwccacatttatgtacttagcacaatttgtacatattggagtgtgtggggcatghdaacttgaaaggactacttgtttgagtgaagtactgcagtctgagtgatacaaattgggtgaattaaagtggc

SEQ ID NO: 32472 - DNA, 432 bp, Homo sapiens
  misc_feature 131: s=g or c
  misc_feature 134: w=a or t
aggctggcccggggcaggatttttgtgatccgcgattcgctcccacgggcgggacctttgtaactgcgggaggcccaggacaggcccaccctgcggggcgggaggcagccggggtgaagaaaccaagacgsagwgaggccaagccccttgccttgggtcacacagccaaaggaggcagagccagaactcacaaccagatccagaggcaacagggacatggccacctgggacgaaaaggtaatggattctgtggtcttgcagcattagaggatatcccagccttgagaggataattctgtttggtgtttcaaacaggagagggagaactccctgttcaggtgtttccactatactgaaatatttaaaatcaaaatgatgaaaagctgtaaaaggcttcacaaaacctccaagtagctgatattccacatcaga

SEQ ID NO: 32473 - DNA, 123 bp, Homo sapiens
ttgtttgtttgagtgaatcggaaaggaggcgccggctgtggcggcggcgggagctgctcggaagctacacctcgcaagggctcccccctttccccaccccctcccccgacccttttcccctaa

SEQ ID NO: 32474 - DNA, 477 bp, Homo sapiens
  misc_feature 128: v=a or c or g
  misc_feature 138: r=a or g
taaaaaaaaaagacacccaggattaccaggtctcttagatttatatttatttccaggtttaacttactaggtcaagtctttttctaattattatttttgagacacggtctggtctgtcactctgtcgvcctggcttgragtacagtggcatgatcacagctcactgtagcctccacctcataggctcaattgaccctcccatctcagctactaaagtagatagtactataggtgtgaaccaccatgcctcgctactttttttttaaatttattttgtttaaatagagatggggtctccctatgttgcctaggctggtctcgaactcctgggctcaagtgaacctaccaccttgacctcccagagtgctgggattacaggtgtgaggttttttgtttgttttcaagacagagtcttgctcagtcgcccaggctggcttgcagtggcgcaatctcagctcactgcaacctccacctccc

SEQ ID NO: 32475 - DNA, 171 bp, Homo sapiens
tgtttgtttgtttgtttgtttttttgagacagagtctcgctctgttgcccaggctggagtgccgtggcgcaatctcggttcactgcaatgtccgtctcccgggttcaagcagttctcctgcctcagcctcctaagtagctgggattacaggcgtccacaaccacgccccac

SEQ ID NO: 32476 - DNA, 165 bp, Homo sapiens
  misc_feature 130: s=g or c
tttgttttgtcgtactgatgagaagtatttttccatttttcttttctttttgttttttgagacggagtcacgctgtgtcacccaggctgaagtgcattggcccgggtttgagtgattctcctgcctcagsctcctgagtggctgggattacaggcacacaccaca

SEQ ID NO: 32477 - DNA, 285 bp, Homo sapiens
gtaagaaattttattggaatttatattagcctcttggtacaccaatattgcttagaggccgagtaatccaaaagttaggaatgctaagtgttctttatgttcaaattaataaaaagagggatgagaacactttagaacaaggtgtccagcaaccaagaagcaaatgaacagttttttagatttagcttgttgtgaatctattttggcatgtcatgtacagttaaatggcctcattataaaagttcacttggtacagtacattatgatatgttaatcaaaaccact

SEQ ID NO: 32478 - DNA, 447 bp, Homo sapiens
  misc_feature 137: y=c or t
  misc_feature 138: r=a or g
  misc_feature 142: m=a or c
  misc_feature 343: b=c or g or t
  misc_feature 354: b=c or g or t
  misc_feature 355: n=a, g, c or t
  misc_feature 356: r=a or g
taggtatgtatgtgttttaagactttgatgctttcatgttgtccttgaagttccatctattatacaaaatgaatgatggcatgtatatagtatgtttttaaaatactgtattataatttctaaaactttaaaaagayracamcttcagaaagtcaaagccatttataggaaatcagttttcctgatgcatagcattttggagttaaagagaagactaaaaatttcttgctcttgtgatggcggttagatgactatatatgtcagaactcattgaaccatacacttaaatattttttgtatataaattatatgtctataaagctgacttttttgtatataaatbatatgtctatbnrgagctcttttttttgttgttgttgagacagagtctctctgtgttgcccaggctagagtgcagtggcgggatctctgctcactgcaacctct

SEQ ID NO: 32479 - DNA, 439 bp, Homo sapiens
  misc_feature 137: m=a or c
  misc_feature 141: r=a or g
  misc_feature 147: k=g or t
  misc_feature 353: m=a or c
  misc_feature 373: k=g or t
  misc_feature 391: k=g or t
  misc_feature 416: m=a or c
tttgtattctggtatatccttcaaggaaaaggacaggtgatcagtgcatttagacatccagaagttacttccactattgaggaactatgtagacatgaatttaagcttgtacatgtgccaatcttgttaatggtcamcttraccackgattcacatagacagacattaacgtctgatgcctcaggttgatggcgaactttcttcctagtgtcttaacatttatgaacttatgtttgacttgaggggcatttcagcaaagctgtgaggaaaagtaggttctggactgatgtctgctttgtgccatagaaattttggaacataaggaagtatctgcttctactatatgtacaggmcttgtccccaaataatttckgaatcccttaatgcagtkgagaatcccttaatgcagttgagamcagtaaagttcatgaccatacgc

SEQ ID NO: 32480 - DNA, 286 bp, Homo sapiens
  misc_feature 128: s=g or c
ttgaaataaatggacaagtagaaagtcttagcaaataaatacaagacttaagggagaaccaaatgaagtattagaagtggaaaaatacaaccaccaaaataaaaagtctggcacataggctcaacagsagaatggatggtgcagagcaaggaaatccatccactgccaatgaaaaagtagaaattacacaatcttagcagggaaaaaatagactcggggagaaagtgaatagaacctcaggcacctgtgaaactacctcaaaaggtctcactttcatgttgtcatc

SEQ ID NO: 32481 - DNA, 459 bp, Homo sapiens
atcccaacattttattcagataaaagtcgaacaatgccctacctgtaggtaatctaggcctccaaagctcttcttacatcacctcctgtaactctccccctttctcactcctctacagccacacagctgcctcactttcctttgaacgtaccaagggcaatcctgcttcagagcctttgcacttgctgtttctgggccaggaattccacacccaccttccctcacatgtatcccaaggctcactgccttccttcagttaagtctgctggaatgtcacttcattaggtattgcctgatcaccttttctaaagtgagtctcacctccaccctcaatgctggcaatgtctgtctgtagtgtattcttaacaatacagattagcacaatgcaggccagaccatgaagactgtttcaagttcgaggatgggcaaaaataatgactaggacttggctcaagattc

SEQ ID NO: 32482 - DNA, 399 bp, Homo sapiens
  misc_feature 128: s=g or c
  misc_feature 390: m=a or c
caaacagttacgggagcaagtgtcccaagatttaatgccttgcagggaacccagaacccagcctcacccctgcccagcttcgacgaggtagactcgggggaccagcctcctgcaacatccgtgccagstccccggagccaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccamcccccccat

SEQ ID NO: 32483 - DNA, 351 bp, Homo sapiens
  misc_feature 139: w=a or t
  misc_feature 140: k=g or t
ccatgacgtgagaagattctgcctttcgaagccacccccgctccctctgccccactccgcccctcctggtctctctgcagaacctacgattgttagtagaaacagctggaaggttcttttaatgtggccctgaaggtawkaccaaaaagaaatattttaataaatttttctctctatcaaaggaaaagccaagtgcaatatatttggtgtaattctttgaaaaagggcccagctgttttcccaaggagctctggtccattccatcttgtgcagaagattcattctgacagtggaatataattagaaatgcgtcgttcagcctgcccccacccccaaacacacaaacacacc

SEQ ID NO: 32484 - DNA, 265 bp, Homo sapiens
  misc_feature 253: n=a, g, c or t
caaagacaaaatagcatatcaaaagttaatcactcagttggaaagcactcataccataggcttttattcatttcttgaataattttgttatatcttcctcttttaggctgcaatgagctataattgcactactgcactccacgctgggtgacagagcaagaccctatctctaaaaataaaaaagtatatatatataaaaatatcttcctctattataatttaactcattaagccatttatttagatgtaaacntgcccccctgcc

SEQ ID NO: 32485 - DNA, 55 bp, Homo sapiens
  misc_feature 48: y=c or t
tatcattcatttctgcagggtccttaagttttcactcttttttttttyctttttt

SEQ ID NO: 32486 - DNA, 436 bp, Homo sapiens
  misc_feature 127: y=c or t
  misc_feature 128: b=c or g or t
  misc_feature 129: w=a or t
  misc_feature 130: m=a or c
tatgtccgtgctgattttcagtttgtttctgccatcaattattgagaatgaagtattgaagtcttcagctattgtttggttgaattttctatttctcccttcaattgtacatatcactttaatactybwmctttaataacaaaatctggccacctctcaatttaaaaagttaataaagaaatagagaggcccggaatggtggctcacgcctataatcccagcactttgggaggccgaggtgggtggattacttgaggtcagtagtttgtgaccaccctggccaacttggtgaaaccctgcctctgcaaaaatacaaagattagctgggtgtggtggcatgtgcctgtaatcccagctgcttgggaggctgaggcaggagaatcacttgaatccaggaggtagaggttgcagtgagccgagatcacgccactgcact

SEQ ID NO: 32487 - DNA, 490 bp, Homo sapiens
tcatcttagatgtggtgaagtgtgagaatgagaatttatagcatctacctgggagcaggtttcaggggggaatgcatggatggagagatttaggggagagacttcaggaaatgagaagcctctattggagggtagatgccaaagaggatggaaggagcaaaattggaaacagaattgcctctgtaaccagtttatttagtgcagctttactctttcgccataactgtccccatgaactctccttctttgtccttgattcaaagagccattgtctctacctcctgatgtgcatcctccttcccatcaggctccctctagtcttattctccccacaccagccagtagtcattttcatatgtaagtctatttaattattattaaatagactattagtgtaagtccattgccctttgggtaaagtgcaaattacgtaaccgatgaggggattgacattgttaagactggcataggtataatagagatgatctta

SEQ ID NO: 32488 - DNA, 249 bp, Homo sapiens
  misc_feature 146: h=a or c or t
tgtgtgtgtatgtatgggtgtgtgtgtatatatgtgtgcgtgtgtgtgtatgtatgggggtgtgtgtgtgtgtgtgtatatatacggagagagatttctggagtttttcttgtcttaacgagtttccgatcctaaactattgagghataggcacaaatttctgacccttcctcccctttctggttgtttcacttccagaaatccgacagaaagtacaaatttttacatctgagtctctaccaagagccg

SEQ ID NO: 32489 - DNA, 278 bp, Homo sapiens
ccaagatcaaaccatgaagaaatccaaaacctgaacagaccaataacaaataatgagatcaaaattataataaaaagtctcccagcaaagaaaagcccaggactcaatggcttaactgctgaattttaccaaacatttaatcaaagaagaacaagtaccaattgtactctaactattcagaaaatagaggagagagtacttccaaacgaattctacaaagccaatattacactgataccaaaacaaatgacacatcaaaaaaagaaaactacaggccc

SEQ ID NO: 32490 - DNA, 268 bp, Homo sapiens
ggcgggaggatcacttgagcccaggagttcaagatcagcctggacaacataatgagaccctgtctctacaaaaaataatgaaaaattagttgggcattgtggtgtgtgcctgtggacccagctactccgggaggctgaggtggggagagttgtttgaccaggaggtcaaggctgcagtgaaccgtgttggtgccactgcacttcagtctgggcagcagagtgagaccctgtctcaaaaaaagaaaaaaaagattataatagaggccgc

SEQ ID NO: 32491 - DNA, 240 bp, Homo sapiens
tatatgcgcgaccaatgcgcccaccacaaacttactttttaaagtattactgggcatgccagaaagtgggagaactcttcaagggacacagggagtggcaaatgggcaggagaggtgcgccatccctagcctggtcagcatgggtcacccccacagggaggagctgaacccgacattcctccaccatgcaggaaccaagaactgaagtcaccacatcatgtattttctaaaccagagcag

SEQ ID NO: 32492 - DNA, 353 bp, Homo sapiens
ttgggtaattaagtcataacccaggaaggttaacaagcgaagatgaagaaaaaggaaagtacaaatgtattcacacaagtatatatacatataatatgtgcaatatatacatacaaacatatatacataaaatatatacatataatacattgatattcatacaagtacatattctgatgtagtaacaagttttgtaattactgagttacatttatttgtttgatagagtaaaaaaaattacaaaataaatttgaaatctatttacaagtttagtcttagaaaattcatggttaggtttgtctaagttaaccctgctgaggtgattaaaataactgtacgcttctaagtgtagc

SEQ ID NO: 32493 - DNA, 261 bp, Homo sapiens
aggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttcc

SEQ ID NO: 32494 - DNA, 479 bp, Homo sapiens
  misc_feature 126: r=a or g
  misc_feature 148: w=a or t
  misc_feature 239: r=a or g
  misc_feature 328: r=a or g
  misc_feature 329: r=a or g
  misc_feature 339: d=a or g or t
  misc_feature 374: r=a or g
  misc_feature 434: k=g or t
gggagttttattattactcaaatcagtaccccaccccacccccgagcatttggggatcagagtttttaaggacagcttggtgggtgggggaaagtcagtgagccaggagtgctgattggtcagggrtgaatcatagggagtcgaagcwgtcctcttgcactgagtcagttcctgggtgggggctccaagatcagatgagccagttaatcgatctgggtggtgccagctgatccatcaartgcagggtctgcaaaatatctcaagcactgatcttaggagcagtttagggagggtcagaatcttgtagcctccagcttcatgactcctrraccataattdctaatcttgtggctaatgttagtactacagaggcratctagtccccaggcaagaaggaggtctgctttgggaaagggctgttacgtctttgtttkaaactataaactcagtttatcctaaagttaggtcagcccaggaat

SEQ ID NO: 32495 - DNA, 311 bp, Homo sapiens
  misc_feature 60: n=a, g, c or t
atgtaatgacattaggtttccttgttgtattagtctgttttcgcactgctgataaagacntacctgagactgggaagaaaaagaggtttaattggacttacagttccgcatggcaggggaagcctcagaatcatggcgggaggcaaaatgcacttcttatatggtggcagcaggagaaaatgaggaagatgcaaaagtggaaacgcctgctaaaaccatcagatctcgtgagacttttcactaccatgagaacagtatgggggaaaccatccccatgattcaaattatttcccactgggtcccccccacga

SEQ ID NO: 32496 - DNA, 283 bp, Homo sapiens
  misc_feature 132: h=a or c or t
  misc_feature 134: w=a or t
  misc_feature 139: r=a or g
catttcagtatttaaagctgtagtgtggttgaacagtgactgatgataatttttgaactacgataaactaaaacaacataaaaaaatgcaaagatatattccggtctcttgctcatgtctgtctagctgaahawcctaraacaaatctacttcaaaagattaaccaacagcaatataggttggatatagaaggatatcagtcaggaattctgattgattgagattacaaggaaccctttccatctgggactcatgataattcctcataacgtaatagccgtgc

SEQ ID NO: 32497 - DNA, 100 bp, Homo sapiens
  misc_feature 85: m=a or c
cactcttccgttgctcagcgacgtcaagtcaactacggatccccagctgggacaacctcagggtgcttggctctcggcggttagmacccacagaagaccc

SEQ ID NO: 32498 - DNA, 95 bp, Homo sapiens
  misc_feature 17: r=a or g
  misc_feature 29: y=c or t
  misc_feature 31: w=a or t
  misc_feature 78: k=g or t
caaatcacacaatacarttcatctcattycwttctaatctttggtacagtagtgtgttgtactatataataatgatakaatgttttgttcattga

SEQ ID NO: 32499 - DNA, 335 bp, Homo sapiens
  misc_feature 131: s=g or c
aatagcctgtgaagcttttctttagaccataagaggtcttttccatcccataatatttattgccaattatttatccatgtctagatgagactagaagaatccgaatccccagtaatgagttgtcagcattscttaatgtgacctcaggactgatcatcatatgctttttgcctgtgtaggtgttctaagcgttgtataatcacttaagaatggacttcattaaatagacaaaatatgagagccattacactatttttggtattaagtctttgaaatccagactgttttacacttgcaacacatacacttggggctaatcacatttcaggtgctca

SEQ ID NO: 32500 - DNA, 195 bp, Homo sapiens
  misc_feature 140: r=a or g
tgtgtggtcctattaattagggtaagttattttccttggaattaaagggagtatttttaaagacagacgtatacttttggttttgttggtctttggaccatgtgtgccttcccacaatctctatcaaagagtagatggartgaatgacaataagaactaaaatttattgaactttctgaaatattttaggcacgt

SEQ ID NO: 32501 - DNA, 311 bp, Homo sapiens
  misc_feature 133: v=a or c or g
taattgggacccagagacatctaatctctaagttaaagcaccactccttttactcataaccattggaggcatcccaaagtctagaaaagccgaaatgaccctcaattcatattctggtgttatttaaccccavgcctctgggaggcgctcaagaacaggataatttaatgtcattctcagcctgaaaagttccttagttttcttttaattaaatcagtaattattttaaatgcatcatttcaacaagataccataagttagttgaatgaatgcatgtaaaaccaaaatgttgactggcataatcccccggc

SEQ ID NO: 32502 - DNA, 179 bp, Homo sapiens
  misc_feature 128: w=a or t
ataacttctgtgtctcagtcttttccattgttaaaatgaagacaaactaattgatagttttattttaaacatgagaagcttttcaaaaggtaaactttaacagagcaatttaatttttcctggggtawtcagtgttaaagtcacacaattcaaaactaattcttccaaaggacagctaa

SEQ ID NO: 32503 - DNA, 317 bp, Homo sapiens
  misc_feature 127: s=g or c
  misc_feature 159: r=a or g
  misc_feature 212: k=g or t
tggctactaagggaacttgggaggatcccacctcagccttcgtgactagtgaggccttttgttcctgtcccggaaagccggcgtcctgccgcgcgatgcccctgctcggacttcttcccaggagggscctggggcttcgctgctcagccagctcctgcraccgccctgcgcttcgtgcaccggggcggtccgttgccaaagccaggttgcakaggcagtgttaacatcccaactgaaagcacatcaagagaaaccaaattttattatcaagaccccaaagggtaccagggatcttagtcctcagcatatggttgtga

SEQ ID NO: 32504 - DNA, 195 bp, Homo sapiens
  misc_feature 127: r=a or g
  misc_feature 129: r=a or g
  misc_feature 130: m=a or c
  misc_feature 150: r=a or g
  misc_feature 166: r=a or g
cagtgacattaacacaactgagtaaattaacagtaagttctttgtaggtcaggcgtggtggctcactcctgtaatccagcattttgggaggccgaggtgggtggattgcctgagctcaggagtttgrgrmccagcctgggaaacgtggtraaaccttgtccctacraaaatacaaaaaattagccgggtgtggca

SEQ ID NO: 32505 - DNA, 259 bp, Homo sapiens
  misc_feature 117: r=a or g
  misc_feature 118: d=a or g or t
  misc_feature 124: v=a or c or g
  misc_feature 127: w=a or t
  misc_feature 129: w=a or t
  misc_feature 131: k=g or t
  misc_feature 135: h=a or c or t
  misc_feature 148: w=a or t
  misc_feature 164: v=a or c or g
  misc_feature 213: v=a or c or g
  misc_feature 214: m=a or c
  misc_feature 232: d=a or g or t
  misc_feature 244: d=a or g or t
  misc_feature 245: s=g or c
  misc_feature 246: s=g or c
  misc_feature 247: r=a or g
ctaggaggacattctattcgttgtaaatcaaagaatcttgaagatgacactttgtcagaatgtaaacaggtgtctgataaagctgtttctctccagcgaaagcttcggaaagaacardcattgvcawtwakggthcggttcttcttawaactgaattaccagavgatggttgtactgaagaagatgtgagaaaattatttcaaccatttgggvmaagtgaatgatgtcctadttgttccatatdssraaagaggctaaa

SEQ ID NO: 32506 - DNA, 115 bp, Homo sapiens
caggagatcgagaccatcctggctagcatggtgatgccctgtctctactaaaaatacaaaaaattatccgggcgtggtggcgggcgcctgtagtcccagctactcgggaggcact

SEQ ID NO: 32507 - DNA, 181 bp, Homo sapiens
  misc_feature 16: r=a or g
  misc_feature 130: s=g or c
  misc_feature 131: n=a, g, c or t
ttttttaacatttaaraaatcactattcattatggttattaccgtggttttcttttcttgtggtatctttgtctggtttttatatcagggtaatggtggctttttagaatgagtttggaaatgttctctsncattttagttctttggaagagtttgaggaggattgggttaattccttttt

SEQ ID NO: 32508 - DNA, 441 bp, Homo sapiens
  misc_feature 260: n=a, g, c or t
  misc_feature 365: n=a, g, c or t
  misc_feature 366: v=a or c or g
  misc_feature 378: y=c or t
  misc_feature 382: k=g or t
  misc_feature 383: h=a or c or t
  misc_feature 385: n=a, g, c or t
  misc_feature 404: w=a or t
atactgtcaatatatgcttacaaaaagattgtgacttttgtctggaacacacatcttctctctgtctcactttcactctgtgggaagacagataccatgttgtgagctgcattctggtgaagcttgtgtcaaaagattgagggaggctttcaaccaagagcaggtgagggaatgaggctccaggccaaccacccatgagggactgaatcatgccaacagcctgttgagtgaccttggaagtggatcctatctcagttganccttagaatgagactgctaccaggctgacactttgtgagaaaacgcgagccagaaagcccagcaaagccgtgcccagataccaaacccacaggaagtgtgagttnvtaaatgtttgtyactkhangctactgagtttgtgagtwactttttcatggcaatagggtaactaatacaaatggt

SEQ ID NO: 32509 - DNA, 169 bp, Homo sapiens
tatttttaaattatatatgtatctgtactaattatttacattgtaagtcaaccctaacataatcttaaaggataagatacaaaacatactgcatctagaagcttcagtactttcttcctgaatcccagtagatccttttgttcatcccacgggatgcattccgccaccc

SEQ ID NO: 32510 - DNA, 404 bp, Homo sapiens
  misc_feature 205: m=a or c
  misc_feature 256: k=g or t
  misc_feature 275: n=a, g, c or t
  misc_feature 276: n=a, g, c or t
  misc_feature 336: d=a or g or t
  misc_feature 368: s=g or c
tttttttctctcttgaaatctcagagaaagagattgttacatccttggttttaaggtgttgggttcctttcctgcccctgaaatgtgggctctgccagtgccttttctgcttttctctgggttgtcactagagggcagcatacgcccgtgtttagaagtcagagctgcttgatttacggacagagaaccgagggcgcacactgcmtccttgggctttaggagcacaaaattgtaatacccacgggatatctttatkttactagcaataggatctnnttaaggtaggaaaactgatatgcaggccgacttcttactagaaacggcaaacttcattgdattaaggattccagaatcaaattgctgttagscatgtgaacgttaccatctcacattgaaacaccgga

SEQ ID NO: 32511 - DNA, 459 bp, Homo sapiens
  misc_feature 328: n=a, g, c or t
  misc_feature 329: w=a or t
tatgatccattttgatgataaaccaatgctgagaggctggactgtttgcaattttttaaaaaagagagttcggatttttgagggttgctctgagatttttggtgtaggcttcattttaaaattattttctttttccttccatttctttcttcccttcctctttatcctcctttcttgttactcactcagtgctttgcagatcatattctaaaggaactggaccattttccacttgagaatagaagcgaggtggtcattctgttttctgctcactcactgcccatgtctgtaagtaagaacattttctgggatgacctagtgatagagnwttgggtgatttcattttctaaatgtgtaaaatgggtccagcttccattatgtcctaagcccagtgcaagaatgaattctcaaatctcagacttggtgctaacttagcctcacttcttaaaacctcgtctg

SEQ ID NO: 32512 - DNA, 373 bp, Homo sapiens
  misc_feature 16: r=a or g
  misc_feature 122: r=a or g
  misc_feature 125: m=a or c
  misc_feature 131: y=c or t
  misc_feature 135: y=c or t
  misc_feature 152: k=g or t
  misc_feature 228: r=a or g
  misc_feature 245: y=c or t
  misc_feature 320: w=a or t
  misc_feature 321: w=a or t
  misc_feature 323: r=a or g
  misc_feature 328: s=g or c
caaaaaaaaccctaaraatccacgtgtgtattgtaaataaattcaggcatgcatgcacgttctccttttcagaatgtttagacatagtcctccaaatttcaaatatcctaatgcatttaaaracmacttcyggayttaaaaaatacagtttkatggtgaggtttgggtttaaacaacaacatacaattttaaataatatagctattatgtaaagaatacacctttacrgtttatttgttaaatcytttttaaattgaccgaacaattgatggaaggttatttttaagaaaaagaattatcagtacagctgtttatgcaawwartggcstttatcaaaatggttattgctaaattttatgtgttaataatttaa

SEQ ID NO: 32513 - DNA, 355 bp, Homo sapiens
tacatttttttcttatgctgtttctttacttgcccttctctgagtatgtcagcgttggtggtctgtttcacctgggcattctgaaatgttttatcatagagcagcatcagtaccacctttatcatagagcacatcagccaccacttcccagaggggttctccaagaagagactttacgaagaagagatttaggaaacctagtctatgtctgtctctccctccgtcccacaagaaggtgcccccgatttttgttcatttgaggcagtatgttgggaattttagacaaattaccctatttcatactgtagccaattttttctttttttttcaggaaatgacagagaaaccagaaaaa

SEQ ID NO: 32514 - DNA, 351 bp, Homo sapiens
  misc_feature 299: y=c or t
  misc_feature 301: n=a, g, c or t
  misc_feature 302: n=a, g, c or t
  misc_feature 303: k=g or t
cgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgytnnkattgaatgcaagtgtactgtcattcatagtgtttatatcaaaatacca

SEQ ID NO: 32515 - DNA, 388 bp, Homo sapiens
  misc_feature 333: d=a or g or t
  misc_feature 334: r=a or g
  misc_feature 357: d=a or g or t
taaagctggctgtcattccctgtcagggcaatttgcagtttgttcttcagggtcccaacctaaggagcgggagacttagcagggcctgtcctcggtggacgctgagctccagtatttatctccctgtgagctctgtgagtctgtgagttctagctcagcttgtgaacctcttctttttctcttctgtaattggaagaaaacctaagggggaaaaaaagatcctgctctctggtgttcccttttcttagccttgaaattattatgttttgttcacctttctagttctcagtcagaagatttatctaagttacctagtctatcattattggaatdrttcctttatatagttctagtgadgtggaaccccttcatgtttttcatcagttta

SEQ ID NO: 32516 - DNA, 173 bp, Homo sapiens
tagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtat

SEQ ID NO: 32517 - DNA, 267 bp, Homo sapiens
  misc_feature 5: n=a, g, c or t
  misc_feature 6: d=a or g or t
  misc_feature 137: r=a or g
  misc_feature 171: m=a or c
agtcndatattaaaatgtttgttcaacagaaggtggatggagagcagcattttcaagtaatgggcaataaatcatggaattggagaagttactcaaattttggtaatgtgcccaaagaccctggccatggccttatractgagacatgcataataagtggtggttcttggmcttagggtgctaggaattggttgattggatgtgtgctttaaatagatgatattattggttcaaaataaaatgatggggtgagaactgtaaatgcct

SEQ ID NO: 32518 - DNA, 165 bp, Homo sapiens
caacttgcgtatgttgacatcttaactcccaaagtgattgtattaggagctgggaattttgggacatgatgaagtcatgagggctctgcagaatgggattacccccctcaggtgggtaaagacaagggctattaaagaaggttcagaggtgtagggagccaggag

SEQ ID NO: 32519 - DNA, 458 bp, Homo sapiens
  misc_feature 387: k=g or t
ttggtaaaacttctttctccacaggacttctgttagtgatttgttcatgaactttgaaaggagcaatggcagttcctccccgatctccgttctactcaccacatcccaataccgtaaagtttatgagcagaggaatttaacataatgcattttaagttcataaactaacaaaataacttcagatcttttaaaaatgctttttagaagtttggcctgcatttctacctttttcaccatattctgtctcctcagctacctcctaactccctgaacttaaaactctctggggtcgctttccattaatagcttttgactttgtttcttatgctttggaaatgtatgccatagcgacattgctattttaagaggcttttatatattcacgtkgttctccctcttttctctctgtcttcccttgcccttccttctattccccttcttattcttgccaccccaca

SEQ ID NO: 32520 - DNA, 249 bp, Homo sapiens
ctcatgatatttaggtgtttgtctacgtccccatttgctcctgagccccttgagacccagccttggtcattttggtgtccccagtgcataactccttgcacagaggagatagtaattgtgggattgaagaaaacctcaggaggcagtggttgtttttaatccacactgaagagactagggcagtggtgtttttttaagggtaagagcatgtggaaaggagcaaacaaatgcctgagcagaatccagtgt

SEQ ID NO: 32521 - DNA, 282 bp, Homo sapiens
atttgatcattagtgaagttaagcttttaaatttgtattagtcatttgtctttcttcttttataaattatagatactttaaaattttatgcaagaaaatctatccatattttcttttatgatttctacccttggtcagcaggtacattttcagcacagtgtcttgtacactttcatttttaaaaaatataggtgaattgtattaacttttatattggaagtggacattgagtggacatgtagacacaagatccttgagaatcatttctgccttcgagaagaa

SEQ ID NO: 32522 - DNA, 136 bp, Homo sapiens
tgagatttacatttaactcatgtttacatcattttattttcctgttctgttttatgggaatgattattctatgctttttgaggactacaatttataaatatttgtggattgaatgaataagtgaataccggggcaa

SEQ ID NO: 32523 - DNA, 268 bp, Homo sapiens
  misc_feature 96: r=a or g
  misc_feature 252: s=g or c
cggtttagccattgctgcattgcaccattttacatacaaggcaaattttttctttgaagaatccaggatatctaaacttgtaactgagggccataragaaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacasttgacattttaggaaa

SEQ ID NO: 32524 - DNA, 90 bp, Homo sapiens
  misc_feature 33: k=g or t
  misc_feature 51: h=a or c or t
  misc_feature 52: k=g or t
  misc_feature 73: y=c or t
caatattttaataatcataatatctaatacackgaatctactgttttagthkactatgcttttagtgtactcycatttaattaactttta

SEQ ID NO: 32525 - DNA, 267 bp, Homo sapiens
  misc_feature 15: w=a or t
  misc_feature 116: w=a or t
ttttgttgctcagcwgtattccattgtatagatatgccactgttttgtttatacattcacctgttgatgaacacttggattatttctagttttgggctattacaaacaaagctgcwatgaacgtttcatgtgaaagtttttgtatagacatatacatttgtttcctttcggtaagtaactggaaatggaatgaatagatcaaaatggtaggtatatatttacctttttgagaaactatgaagttttttcccagagtgattatatcat

SEQ ID NO: 32526 - DNA, 80 bp, Homo sapiens
  misc_feature 33: d=a or g or t
ttttaatagacttaagttttttagaacaatttdagatttacagtaagacagagtgaaaagattgagagttcccacataac

SEQ ID NO: 32527 - DNA, 172 bp, Homo sapiens
  misc_feature 101: k=g or t
caataatatttaataatgttcaaattcctctaactgtttcatatatttgttttgtttttgttgtgtatttgtttgaatgagatttcaagtatagttcatgkattacaatttctacatttaaaaattgcgtttaaagtataggttcctcatttctttcgagataatttttttt

SEQ ID NO: 32528 - DNA, 120 bp, Homo sapiens
  misc_feature 4: m=a or c
tggmcaaaagtcaaaattccaaactcacctaaagcatatttttttccttccgcagtagactttgggcttgttgccagtctctcctgcttagctcaggctaaaacggtcatgtctctcttt

SEQ ID NO: 32529 - DNA, 296 bp, Homo sapiens
  misc_feature 143: y=c or t
  misc_feature 284: h=a or c or t
cttatgtttattttgctgaaatttaaacattacaacagccctgttcaaaaaagactttaatatttcttatcagtcagaggtacatctgaattattctatccacagtcattaacaccttgccgaatgcctttatgttgtcaggyactttcaggcattggaattttgctttgtacaagacaaatgtagatccttcagacctattgggttatcaagcatttccagagcttccttgacttgatgctgaagctcatggcttctaagtctagaatcacagaagaactgghagaaaggccatc

SEQ ID NO: 32530 - DNA, 51 bp, Homo sapiens
  misc_feature 17: k=g or t
  misc_feature 27: y=c or t
atagatttcaatttgaktaccttgggytttccagctaagtaatcatatcac

SEQ ID NO: 32531 - DNA, 192 bp, Homo sapiens
ttatgttggatctgaatgcccaatagtctaacaaagtcttgtaccttaataataaggtaatggccccagatcttgtctacacactttagaacaatctgcaagtatggatatgtttctaaggatgtgtaaatttaatgtttaataaagatgtaagttatgtttctaattaggtggaatcaaaaagaagtcggc

SEQ ID NO: 32532 - DNA, 121 bp, Homo sapiens
taggacaagagacacaatccaggaactgaaagaatctcagcagagccaaaaggcagagtgcgctttaaaaactctactgaaagaaaatcaggaactttcctatgcaccaataagagcccca

SEQ ID NO: 32533 - DNA, 87 bp, Homo sapiens
aagaatagcaatgagtcgggagactttcgcgggctgaaattgggagctccaagcactttttccccccactttttttttttttttttt

SEQ ID NO: 32534 - DNA, 346 bp, Homo sapiens
  misc_feature 302: h=a or c or t
  misc_feature 303: n=a, g, c or t
  misc_feature 304: n=a, g, c or t
attgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatthnntgtcacatggcaaatgggattgaagactgtgatgatcagcca

SEQ ID NO: 32535 - DNA, 215 bp, Homo sapiens
  misc_feature 136: w=a or t
  misc_feature 137: r=a or g
  misc_feature 160: h=a or c or t
  misc_feature 161: r=a or g
aacaattagagctagcatttcatgtagtctgaaattctaaatggttctctgatttgagggaggttaaacatcaaacaggtttcctctattggccataacatgtataaaatgtgtgttaaggaggaattaacaacgwrctttgatttgaatactagtagahrctggccaggaaaaaggtacatttttctaaaaattaatggatcacttgggagccg

SEQ ID NO: 32536 - DNA, 418 bp, Homo sapiens
  misc_feature 38: s=g or c
  misc_feature 134: r=a or g
  misc_feature 140: m=a or c
  misc_feature 141: h=a or c or t
  misc_feature 142: r=a or g
  misc_feature 292: m=a or c
  misc_feature 373: w=a or t
  misc_feature 378: k=g or t
ttactaagccctggccgggcatggtggcttgcacctgsgattccaatactttgggaggttgagcaggcgggtcacttgaggtcaggagttcgagaccaccctgggcagcatggtggaaccctgtctctactaaraagtamhraaattaagtggacatggtggctatcccagctgctcgggaggctgaggcaggagaactgcttgagcccgggaggcggaggttgcagtgagccaagattgtgccactgcattctagcctggatgacagaaccagactctgtctcaaaagaamaaaaaattatttaccaagctgtgttttcatagtgttttttaattctctgaactgcttcaggtatctgcagtgttttttttwcattkcaaagacttcccacatgtaacatttcatttggaattacca

SEQ ID NO: 32537 - DNA, 291 bp, Homo sapiens
ctctgcgtgaattactttctccattgcaactcccctgtcttgataaatgggctctgtctaagcagcgggcaaggtgaactcgttgggctgttacaggaccagtgacagaccaagggcatgccactgaaggaatccctagacgcacccttctggatgtgagacaggcggatctcacccacgcctgccagcagctcctcggagaactgtgttcctgggtcagccctggcccagaggagcgccggggacccgcagagtgctgctgaagtcaaggctacaactcacctgggatct

SEQ ID NO: 32538 - DNA, 185 bp, Homo sapiens
  misc_feature 14: r=a or g
  misc_feature 15: r=a or g
ctagacatgtagarratcactgtaaaacaaattagtcaggcatggtggcacatgcctgtagttctggctacaggggaggctgaggtgggaggatcctttgagcccaggaatttaaggctgcagtaagctatgatcatgccactgcattccaggctgggtaacagagcacgaccttgtctctaaaa

SEQ ID NO: 32539 - DNA, 326 bp, Homo sapiens
  misc_feature 135: w=a or t
  misc_feature 142: w=a or t
  misc_feature 168: d=a or g or t
  misc_feature 169: r=a or g
tgtggagggatgacaaggaaataatcatgttttctaatatccttgggcaataaatgagactgggaagggcagcatggaacttgaagagaattaggcagattttgccacaaattatgttgtgccagctaacttggwttttgtwtgtttttgtgacctcttctctctttdrgctgtatcagctctccaaagctgggaagctctgtgttccggccatgaacgtcaatgattctgttaccaaacagaagtttgataacttgtactgctgccgagaatccattttggatgggtaggttgaatgtatatatattcaaacttctaggggcccc

SEQ ID NO: 32540 - DNA, 155 bp, Homo sapiens
  misc_feature 125: r=a or g
aaaggatgaatttgagagggacatgactggagataggaagagcaactcagaagctgttaagagatgatgcaggcctgaatttaaaatgtgagctaggatttgaactcaggcctgcctgactccaraaatcaaatgttattatatttctccatatg

SEQ ID NO: 32541 - DNA, 246 bp, Homo sapiens
aaaattgatttttaaaattgttatatcccacacctgtgggcaagttaagctacaacaacctgaattaagtggttaaattcctctacttgtaactgaatgaacagtttcagaataagatacccaagcaaagttaattaagcaaatgttgctctaacatgcaatgactgtatctttgatagaatatatacttaagaggcctggtgcagtgttcatgcctgtaatcccagcactttacgggggccaatt

SEQ ID NO: 32542 - DNA, 350 bp, Homo sapiens
  misc_feature 262: m=a or c
  misc_feature 299: w=a or t
  misc_feature 332: r=a or g
taaaaccaggtcttctgactttaaggcctttcttttagtgttttcccttttcttttccttaagtcactaaaatctgtagttatataatcttacataaagcatatgcaaaatagaaaaatgatagtcaccacatatctactaatgggattaaaatgtacaatcctaaaagcttacttgttagcacacttgcttatctgtccattcattcattgaaccagtaagtatttattgagagttagtgggaatacaatgctgtgcaagmcaaacaagatccctccattcataccacttaaaattcwaggtggggaaaacatctgcacataacaaactarataaaatgatcataaaat

SEQ ID NO: 32543 - DNA, 241 bp, Homo sapiens
  misc_feature 133: w=a or t
caattcttcctattttatagtagctcgctggtttggtttgaaatgactccatctctagatccaaaggtaggcagtgattgggagtatgtaccagtcagtgcaacctcattttcccaggtcacagtgactagcwaagggaggtctaatcctcaggagaggattaggtgaatatacatcacatgctgatatggtttggctgtgtccccacccaaatctcaccttgaattataataatccccta

SEQ ID NO: 32544 - DNA, 395 bp, Homo sapiens
  misc_feature 112: m=a or c
  misc_feature 171: m=a or c
  misc_feature 172: m=a or c
  misc_feature 275: n=a, g, c or t
  misc_feature 276: b=c or g or t
  misc_feature 278: n=a, g, c or t
  misc_feature 279: n=a, g, c or t
  misc_feature 304: m=a or c
  misc_feature 306: k=g or t
  misc_feature 307: y=c or t
  misc_feature 351: v=a or c or g
tttttaaactgttatctgattatttcttttaccaacatgatatagaaaagtgtatttccagtattaaaatttatcagactgagcttactgttcctgttaatgactggaatamaaattggcataaatgagggtctgtatgcttgttttaataacaccaccaccaagatagammacgaggaggcaagtttctccaagggtattttgaaatgtgttagcaaaactattgcagatactcgtttttgttatagggtgaggtggggagaggcgcatgctanbcnngctgttgaaactagggatgtagagmakyaaaagtttgaatataaattattttgtagttataagtagcagtgvaattaaatctcctgcaaatagactatagaagtatattttagcca

SEQ ID NO: 32545 - DNA, 302 bp, Homo sapiens
taatgcagtttgaactatggattagaagccttgattacagattcttaacacctttgttattatatttatatgttctgtcttataggaaacatggagtgccagcagtattgacctttttaattgatctcgtatctatgcagccctggtttttcttttttcataaaaatgtaactagattttttttctctctctctcttctcttttttttctctttaaagacacggtctcactctgttgcccagctcggactgtagtggcaggaacataagagtcttataggaaacataagagtgccagcaaaa

SEQ ID NO: 32546 - DNA, 204 bp, Homo sapiens
  misc_feature 16: r=a or g
  misc_feature 142: k=g or t
  misc_feature 143: k=g or t
  misc_feature 150: y=c or t
  misc_feature 185: k=g or t
  misc_feature 188: k=g or t
  misc_feature 191: k=g or t
attgcagttttccaargctgtaaaagtgtattttttgctttaaatatttacatttcttaagggtgtatttttttttaaagaatttagcatgcctgtaatcccaaagtgctggtattacaggcgtgagcaccgtgcccagcckkctgttcyatttaagaactttgatttccattccattttcattkatkackgtttaggccgcct

SEQ ID NO: 32547 - DNA, 203 bp, Homo sapiens
tccctgggctacactctttcccttgctcttaaagaatgtaatatttttctggcctggcgttgatgtttgaaaagttccaggaatacccaggctctggctctccctggctttcgtagagatatgtggccataactaagaagtaacatattcaggggcagatcatctttcttgtacatcaagcactgtgacttcaggctggggat

SEQ ID NO: 32548 - DNA, 365 bp, Homo sapiens
  misc_feature 97: m=a or c
actcccctcacaccgctccctacagcttgtactctgcctctgactctcttccaagaacaatttggcaagttctaatctacatcttgcaaaaaaaaamcaaaaaacaaaaaacagaggtaggagggccacagcacctggggtcccagaaggcagactgacctattcctacagcagggagacaaggtctcattctgttgcccaggctggagtgcagtggtgcaatcacggttcactgcaacctggaactccagggttcaagcaatcctcctgcctcagcctgccgagtagctgtgacaacaggtgcgagccaccatgcccagctaagatttcaccatgttgcccagctggtcttgaactcctggcct

SEQ ID NO: 32549 - DNA, 405 bp, Homo sapiens
  misc_feature 206: n=a, g, c or t
  misc_feature 210: s=g or c
  misc_feature 253: d=a or g or t
tttgagacagggtcttgctctgtcgctcaggctggagtgcagtgtcataatcatgggtcacagcagccttggcctcccaggctgaagtgaacttcccacctcagcctccctgagtagttgggactacaggcgagtgccagcacgcctggctcattttggttttttttgtaaagatggggtcttgtcatgttgcccatgaaggtctncaastcctggtccaagtgatcctcccgcctccgcctagcaaaatgcdgggattacaggtgtgagccaccatgcctggccttagttatttatttaattatgaatgaatgaatgaattaatgagagggagtcttgctctcttgcccaggctggagtgtggtggcacgatcttggcccactgcaacctccgtctcccaggtt

SEQ ID NO: 32550 - DNA, 146 bp, Homo sapiens
  misc_feature 127: h=a or c or t
  misc_feature 129: r=a or g
  misc_feature 130: r=a or g
  misc_feature 141: s=g or c
  misc_feature 143: s=g or c
agacagcacactgctgactgttttcagttgtttctgtaacagcagaaagtgcactcactaggagtagtcagaattcaaaatgctcaagagaaagccatccaatgtttcagagaaggagaaacatcaharrccaaagcgaasascac

SEQ ID NO: 32551 - DNA, 260 bp, Homo sapiens
  misc_feature 200: m=a or c
  misc_feature 202: h=a or c or t
gaagctgcccggcgccattttgcttgtgggctgccgcccgccgttgtctctccgcggaggctcgaagatagcaaactggaggcggtgagggggacggaatctctgtctttctgacaacagatgcattcaacaatccaccgaaggtttgaggaagtgtcggtattggtgggactggttctttccccctttcccccagtggmchtcaagtctggatataggtgagcttgggcatgccagtattgggtgcacgaacaaggaca

SEQ ID NO: 32552 - DNA, 447 bp, Homo sapiens
  misc_feature 290: r=a or g
  misc_feature 388: s=g or c
  misc_feature 436: m=a or c
caccatccgatattattaaatgtcctatattttaggttatataaaaagtagccttcgagtcattgcagtctgtaaaaagatggtattgatacttatgtatctaaagcatactgcagattaattgaagtatctggaaataggtgtttccagtgtaaatgaattgattctatttatagccttttgaagaaaattatacttaatgggtaagtgtaagctatccatattaatctagctaatgaatggcttgggacagaatttgacgtttgctatgctgtgtgtatatatacagraccggtgaaactcaataaaagcaacgtgaatcaagattattgatggcagggaatagttagcatgacctgtaatgtgaaaaacagcagaaactggtgtsagagaatttaggcaaatctaatttgcttgagtacttagaggagggccmcttggaattat

SEQ ID NO: 32553 - DNA, 112 bp, Homo sapiens
  misc_feature 61: s=g or c
  misc_feature 62: m=a or c
tccttacaggatcatcttaaccttcacagtggagataagccccataaatgtaactattgtsmtatggtttttgcacataaaccagttttgaggaaacaccttaaacagctgc

SEQ ID NO: 32554 - DNA, 294 bp, Homo sapiens
tctttcttttcttttttggctttagatcacatctatgaaattgaaattttaactcttttacataattacctctttctctctgtcacccatctctctcacatatacttccaaactgtcttcctttctcccacatcatccttttcatttttattttgatatattttttaggatggagtctcgctctgccacccaggctggagtgcagtggcgtgatttcactcactatagcctctgcctcctgggttcaagagattctcctgcctcaggctcctgagtagccattacgcccagcaa

SEQ ID NO: 32555 - DNA, 420 bp, Homo sapiens
  misc_feature 202: k=g or t
  misc_feature 262: n=a, g, c or t
  misc_feature 275: d=a or g or t
caatttaggtttctttttaagtatgcgttcaggattttactgttagactaaatgtaaaatggagtcaatgtctgtggagtactgacatgaacctggagagtgaacattttgccccttctcagggaagcaggccagaatatctgtaaaatggtgacactttgatcctgactggaagaaaaccatgttgaaagaacgataagckagggattatggaacaacaaacataagttgtcagctgaaggagatgttcctgtcaggcatngaacttgatgaadttcttcagctggtatagacagttcaggtgtaggctgtagttttcattggtagtggctgtggggtgctgcatcagccagactgacactaggttgccatccttctcagtgggcacatgaggaaatcataatgatggctatgttagca

SEQ ID NO: 32556 - DNA, 166 bp, Homo sapiens
  misc_feature 94: s=g or c
  misc_feature 95: m=a or c
  misc_feature 112: s=g or c
  misc_feature 115: s=g or c
  misc_feature 116: m=a or c
taaagaaagcactgacagcttttttgtctgatgatataccagcataagttaattagatatttataaagatgaaacacaactaataagaaaatgsmtcgagcttgtattagasggsmaagcagcaaaccttctcccttggccccttaggattaaatgcgccccagga

SEQ ID NO: 32557 - DNA, 415 bp, Homo sapiens
catacagtttctaagggtacaacctgtgaagtcagacttcctgagttcagatctctcagccataactagctatctgaccttggccaagtatgctcaaagtcacaaaaaccttagtttccttatgtgcatgatgattataataccttttgtacagttatgaggaaacttagacaatgcctgtgttgtatggtaagcgttttcataaatgctgcctacctgtaagtagcattatagtgtgtagttattggttaatttcctttttctttaccagaagtgtgggttttgcccagcctttatacaacttcagtatttctggttaatctgtctctctatggctctaaacttttcagagtggtgggggagttaccaacacttttgtaaaaggccagatagtaaatgttttatgctttatgta

SEQ ID NO: 32558 - DNA, 173 bp, Homo sapiens
  misc_feature 123: k=g or t
  misc_feature 124: n=a, g, c or t
tgaatgggtgaatgagtgattagatggttgcatgatagaaagcccaagaactttagttcctgcaaaatagggatactacctcttcttctttttcaaaaggtttctgtaagcattcaaatataknctgaatataaggtgcttgcaagttttaagggtataattagacatgaggg

SEQ ID NO: 32559 - DNA, 100 bp, Homo sapiens
atattcttcatgttcattttctaatgttgatctttgataaaagaacaaaatgttaaaattctgtgaaggctagaaattgattttctggaattggagccta

SEQ ID NO: 32560 - DNA, 129 bp, Homo sapiens
  misc_feature 102: s=g or c
ttccggtcctcggctgcggcgggcaccatggtcggtggcgaggcggctgccgcagtggaggagctggtttcgggggtgcggcaggcggccgacttcgcggasagttccgctcctactcagagagcgaga

SEQ ID NO: 32561 - DNA, 142 bp, Homo sapiens
tctctctctctttctctccctctcctatcggagcacaatgaaagcctgtgtatcgccgtgactccgggcgggagccagtgtcagcaaagcggctaacaacagacgagaaagagaaaggaaaatacaagctactttttttttc

SEQ ID NO: 32562 - DNA, 465 bp, Homo sapiens
ttcagggatttagcagattatttgccaatctgggttatgtataacagttctgctttatatgatgtatttaattcaaggaagcatgtgccatgtgaagatacaatcaaagagataatatgaaatcaaatgaaatttactttcacgtaagatctggtaaccttatctatatagtatgtgtgtgtactatttattacatatcagtatttacaaatactgtttaaaactagataaattaaagtactcttcttttataggtgttgtcagtgctaaagcattcattgctgtcttttaagagacaaagagccatggagactttgaaactttactttttgttttccttgcagctccttatcaaagaggtatcatcgtgctttggctttttgttctctgtaactagtaccgtgtaaacttctttctatgctaaaccaactgaaatttctataatctgcattcaatgataatgtt

SEQ ID NO: 32563 - DNA, 156 bp, Homo sapiens
ctgagacctggaaaccccccctctcacggttcttcagaatcatccctctcttccacgtcctattccagccccgcccaccctgtgtccacagactcgttggccccatttacggggacaccagggtattttagcagccagccacattctggaaacagc

SEQ ID NO: 32564 - DNA, 162 bp, Homo sapiens
  misc_feature 58: s=g or c
aacaacggcggccgtgactatgctctacgtgggcccgagcacccgggcagtggcggastccggagccgcagggctggatccactttatctgagacgaggcgcctgcggccgacggcggaaaacaccaaaggcacccggggggcgggggcgacccgatgtggc

SEQ ID NO: 32565 - DNA, 267 bp, Homo sapiens
  misc_feature 137: n=a, g, c or t
  misc_feature 138: s=g or c
  misc_feature 139: n=a, g, c or t
  misc_feature 140: n=a, g, c or t
  misc_feature 148: y=c or t
  misc_feature 149: d=a or g or t
  misc_feature 152: n=a, g, c or t
  misc_feature 158: r=a or g
  misc_feature 159: d=a or g or t
  misc_feature 160: w=a or t
  misc_feature 169: n=a, g, c or t
  misc_feature 171: d=a or g or t
cgtcaccatgctgctgagattgttctctgctgtgtgtgtgtagttctccttcagatgcacaggccacagttcacttactcatttactgatgagtgtttggggttttgactattaggaataaagttatgatgaacatnsnncaatgtgydcgntcatcrdwcaccatggngdccagaatggtctccatctcctgacctcatgatccgcccgcctcggcctcccaaagtgctgggattacaggcatgagccaacgcacctgggctaggg

SEQ ID NO: 32566 - DNA, 384 bp, Homo sapiens
  misc_feature 210: w=a or t
  misc_feature 327: r=a or g
  misc_feature 340: k=g or t
  misc_feature 359: d=a or g or t
  misc_feature 360: r=a or g
tcaagaatgtggacatcagtaagacatgggtctaagaaggctgatggtattatgtattgacttaaaacaacattaccaagcatgtccatccatcttattttttagacctggttatttccaaaaatcagatccaccctccaagaatcaagatgtgatattattaagggtattcaaaatttattgtcatctttgcagtgagcatttctcaawagaaattccatcaaatgatttgggcagcggtggagtcatcatttagcttcccaggaaaactaccttttgggagaggactcactttcatggcattttagtattgtttttaatcattcrctgtactttctakttgtatatgcactttcaadrgagcacatattatttacacactta

SEQ ID NO: 32567 - DNA, 131 bp, Homo sapiens
tctgtcaccaaggctggagtgcagtggtgcgatctcggctcactgcaagctccgcctcccggattgatgctattctcctgcttcagcctcccgagtagctgggactacaggcgcccgccacaatgcccagc

SEQ ID NO: 32568 - DNA, 442 bp, Homo sapiens
  misc_feature 155: k=g or t
  misc_feature 401: n=a, g, c or t
  misc_feature 402: n=a, g, c or t
  misc_feature 404: m=a or c
attttttcccatcgtgctgaggcgggtggcatggcggagaaggatgacaccggagtttgacgaagaggtggtttttgagacattaaaactaccactactatggaagtaccactactagatggaagtttgacctggacatggtggctcacacttgktaatcctggagagacaaatgaagaaagaaatgtcagatagtgataagtgctgtgcagaaaattaaagtagggtgatgtgatggagaatgcctgagtggtcagagaaaatctttctgaagaggtgacatttaaactgatatctcaatgacaagaatgatgtggaaaatccggggaaataacattctaggcagaggagatttctaatacaaagcacctaaagggagaatcatcttgacttgtaaaaannamcagaaagtcactttatgtaaaaatttgtaagtaaggct

SEQ ID NO: 32569 - DNA, 274 bp, Homo sapiens
  misc_feature 210: s=g or c
  misc_feature 265: r=a or g
acagggtgatcctcacagaaacactcaaagccttctgttacgtacaaaggaccgcgtgtcagtaatctacagccatttaccagttaccaagaaaacacggacgtttccactaaaaatcgcaaacgtttctttcaagcaaggagcgccctgcgccagaggctgtgggaggagtgaggagtctgggttcgttccagccgcagtgagtaaggstgggtgactccgagcattgcagaggcatgaggaaacgaaaacaaaacctgccgaratggggcct

SEQ ID NO: 32570 - DNA, 260 bp, Homo sapiens
ttttcacaacaacggaatgacacgaccaagctgcacacgatctttagttcttaatacaaagatcggaaagaaaataaatcagaaaggatattacatcacattacattttctggtgaagcagtttagccatgtctcttactgaggtctgaaccaccacaggacatgaacgcaggggagcgactgaggagcgtggaggtcagttcctctggggggtggaggacgtgacggcgtttacttgaggtaaacctcgcaagagggag

SEQ ID NO: 32571 - DNA, 201 bp, Homo sapiens
  misc_feature 66: k=g or t
  misc_feature 67: w=a or t
agagttaaattaggtgataactaggccatggaaagtattgtttgccctaaagtgccgaaggagtckwaagctgtgaattatttctgcaacttgctgctcagaggcccttttggaagtgatggaacagagtacttaagtacttctaaaggtggctttcattatcttaggccttttaaactctagacttaacaaggtggggat

SEQ ID NO: 32572 - DNA, 105 bp, Homo sapiens
cctagaccgcgtgataaaactgggttgagggatgctggaaccagttacgactgaagtcagtgtagacctgagctgggagggaacctgttagtctccccacctctt

SEQ ID NO: 32573 - DNA, 307 bp, Homo sapiens
  misc_feature 306: n=a, g, c or t
  misc_feature 307: k=g or t
tttccaccaacagtgtataaaagtctgtttccttttttcaagtcaactaaaactctgtctccgactctgtttctctctgtctcttacacatacatgaataagagtctaagggaaataagtaatttgaatttcacagtatgtatatatgaaggtaaataattcctcaaagtttctctgacaatgttctcaaggttaggttaccctattttctttaactgaggtaaaattcagcccacatgaatgaatgaattcattcatggattaattaatgggttatcatgggagaggaactggtggctttgtagnk

SEQ ID NO: 32574 - DNA, 292 bp, Homo sapiens
caacaatttagagctctaacagagaaggaacagcaaggagaatgagtaggaaagacaactgagttacaaagcaaacagaagactgggcatcacaaacccaaaggcatgagacagggatgagctaaaaggtcaagggaattgaggatatagaagtgaccattggtatgatggagttagagactgtggggacttgaggggatcagagttggcctgataggaagggataagaaggtgaaggcagagaccatggggcagagaaaggcactggtagctagagaggaatgtggggata

SEQ ID NO: 32575 - DNA, 398 bp, Homo sapiens
  misc_feature 115: y=c or t
taaagtacacatctgatatatagcttctctacttaattccgtctgttgcttccttattgcttacagggtagaggccacgatccttagcatggatggcataaaaggttgtcgttcyttatcttcctaccttacacttgataatttggcagcaaggagcttgctgtagctcctatctcttgccaccttacctcccacttccttctctaaccctcctggacagtttgggtatcctcagtgctcctagtacatcctgtttctgtcattgtaccctgtactttgtgggtctgattatcagttggctccaacactggaacagtgaacatagtgcgggaacttatcattccccagggcgtggcatagtacctggcacacagtgggtacacggtttgtataactaa

SEQ ID NO: 32576 - DNA, 207 bp, Homo sapiens
  misc_feature 116: y=c or t
  misc_feature 123: k=g or t
  misc_feature 125: n=a, g, c or t
  misc_feature 135: n=a, g, c or t
  misc_feature 156: m=a or c
  misc_feature 178: h=a or c or t
gagcctctacgagagggaaggaacgctgctccgagctccgcgtcgcgtcgcgtagattcgcgtcgccgtcgacctcagaggcggggccggaagcgctacggtttgacccccgagtycctctgktncccgaaaggnccggcccgtctttctgccgamccgctccgcctcctctccttchtccccattacccggaggccgaagcccacc

SEQ ID NO: 32577 - DNA, 124 bp, Homo sapiens
ctcatagaagacactagagaggagaggatatttggaaaccatccagtccaacctctttattccacacttaaagagactgccattgcactccagcatgggaaagaagagtgaaactccgtctcaa

SEQ ID NO: 32578 - DNA, 169 bp, Homo sapiens
  misc_feature 122: d=a or g or t
caatcttgttaaattttgaattgtttataggtagtgttagttttctagggctgctgtaacaaagtactacaaattacatggcttagaacaacagaaatgcattgtcttacagttttggaggdccagaaagtcttaaatcaaggtgccagcaggaccatgcaccccctgt

SEQ ID NO: 32579 - DNA, 233 bp, Homo sapiens
  misc_feature 122: w=a or t
  misc_feature 142: k=g or t
  misc_feature 228: n=a, g, c or t
ccacctgtggttgtatattcttctattctgtcactctgttacctagactgtgagaggcttttgccttcagtcagattaaaaagagcagggcctaacattgagtgatagcacctgctttgatwaaataggttttctcactctkctttttttccttcttttatccctcactccctcccctaaaccctgcttcagcacaatggactaattctagcattctgatcataaggnccctc

SEQ ID NO: 32580 - DNA, 298 bp, Homo sapiens
  misc_feature 277: k=g or t
taaaaagaaaagaaaaagaaaattataaataatctgtggtactcatttttgtcttaccttacagtgctttcgaacagtgctgacagactgttgaggtagcttcctaataggtctctgcctccagtgttgctaccagttccaatcccttattacccattctgaaccacattgtgatttgagtgattctttaatctgatcccagcactatcctacttaaaaccttttcattgtttcttttttctttatgtcatatgcctcaagagcctgctcatcttgkggcttcatctctaccccatac

SEQ ID NO: 32581 - DNA, 149 bp, Homo sapiens
  misc_feature 149: n=a, g, c or t
attctcctcctgcctcagcctcctgagtagttgggactacaggcgcccgccatcacgccctgctaattttttgtatttttagtagagtcggggtttcaccgtgttagccaggatggtctcgatctcctgacctcgtgatccgccccagn

SEQ ID NO: 32582 - DNA, 330 bp, Homo sapiens
  misc_feature 155: k=g or t
  misc_feature 156: n=a, g, c or t
  misc_feature 259: r=a or g
  misc_feature 260: b=c or g or t
cctttttacaaaaatatagatgccaaaatattttagtatgctttcctaacaaataagtacctagttgtatgtataaatacctacaacatcaatattgcaaaacattaataataattacttaattccttttaacacagttcatgttcacattttaknggttatctctttcaattgcaaattgcaaagtcttttgttttgttttgttttagtagttgctcaagttaagagccaaattaagtacatttattcaattggcagrbttgtctcttaaatatttttaaatttataatagtccccttccactcctttcccccttttaattccctttat

SEQ ID NO: 32583 - DNA, 467 bp, Homo sapiens
  misc_feature 269: k=g or t
  misc_feature 334: b=c or g or t
  misc_feature 382: m=a or c
  misc_feature 412: w=a or t
  misc_feature 467: k=g or t
ataatattccactgtatggatattctgtattttgttcattagttgataagatatttgagttctgatttacttttggattctcagaaatagttactcagaactttaaaattgttttacactttttatgggttttacagagttactaatttttgctttgggcagctaagtttgatgtttctgtgggatggacagtaagttggctttgaagctgagagatagatctaggctaaggccaatgattgggaatactgagcacatggatggtaackgaggccacaggagtcaataggattgcccagtgtgtgtgtaaagggtaagaaggaaaagggcttabgatagagtctggaagaatcacagtgtttaagtgtgatttgctccccamtctctgttatggtttgctccatgaaatggwatctgtaacatttaaatgaatttactctttgttttacatagcagttcacttctak

SEQ ID NO: 32584 - DNA, 236 bp, Homo sapiens
cagacacacacacacgctttatagcgttattataaagattaagtgagatgatggatgaagaaagtgatctgaaaagcttttctaaaaactctaaatctgaagtatttatttcttcacccataaacttaaggtagtaatacctttcatggttgtgcacttaatgagataatatatataaagtgcttggaacttagtaagtttcaaatagatattagcatctttttcccctggctctt

SEQ ID NO: 32585 - DNA, 213 bp, Homo sapiens
cttcttcctgctgcccatggctctgcaaagaagacgaagccctgttaccgcggccgtgtgccgttcccccgcagcctcgcgacaaaccgctgcgtggatcagcaagcccagagcctccttcagacaagcccccctcctacggcccccggcccctttttaaggtgcttctaactggcggcaaatcagcacactgatacaaagtgaacaccccta

SEQ ID NO: 32586 - DNA, 205 bp, Homo sapiens
  misc_feature 118: w=a or t
  misc_feature 120: k=g or t
aaagccttcgtgttattggctttatccttgttctggcatatatctctactgtttcactttcatcttactattaatggaaataaaaatatcaaccaacattaatcttggaagtatacawgkttcagcaattgcaaccattagttggctatagatataagagtctggccaacatcaattaaaacgttctgtgggaataaagtggcca

SEQ ID NO: 32587 - DNA, 112 bp, Homo sapiens
caataatgagggcatctgaatttgaagatcgctaattgtatttcccagctctaaagctctatggccatttgagtgtgatgaattatgtatgttaggtatgatcctatttttt

SEQ ID NO: 32588 - DNA, 92 bp, Homo sapiens
  misc_feature 5: w=a or t
  misc_feature 6: r=a or g
taagwraaataacccaggcacacaaaggcaaatattgcatgttcttattcagatgtggaagctaaacaatgttgatacctggagcagagcaa

SEQ ID NO: 32589 - DNA, 347 bp, Homo sapiens
  misc_feature 308: k=g or t
  misc_feature 329: r=a or g
ctgctcctgaatgactcctgagtaaataatgaaattaaggcagatgtcaagaagttatttgaaattaatgagaacaaagagacaatgtaccaggatctctgggacacaggtaaagcagtgttaatggggagatttatagcactaaatccccacaacaaaaaggtctcaaatcaacaacttaacatcacaactaaactagaggccaggcatggtggctcatgcctgtgatcccagcactttgggaggccgaggtgggtggagtgcttcagctcaggagtttgagaccagcctggctaacatggtgagakcctgcctctactaaaaatacraaaattagccggtcatga

SEQ ID NO: 32590 - DNA, 415 bp, Homo sapiens
  misc_feature 118: n=a, g, c or t
  misc_feature 139: k=g or t
  misc_feature 180: s=g or c
  misc_feature 181: k=g or t
tacgtgttttgattagtcctgtcactgtttttatttaaaatgcagtgtcagcaaaccgaaatgctcatttcttttttagtaacagagtactcgtatacttatcactgtatccactcantgggtctaaggggagatgtckgaagtccttcacttaaattattttatgatactactgttttskctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccga

SEQ ID NO: 32591 - DNA, 254 bp, Homo sapiens
  misc_feature 108: r=a or g
gacttcaagatcaaaacagttgaattacaaggaaagaagatcaagctacagatatgggatacagcaggccaggagcgatttcacaccatcacaacctcctactacagrggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgagcg

SEQ ID NO: 32592 - DNA, 447 bp, Homo sapiens
  misc_feature 306: n=a, g, c or t
  misc_feature 307: y=c or t
  misc_feature 424: d=a or g or t
  misc_feature 425: s=g or c
cgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgnygattgggtagctccctgatttggagccagctgtttccagttgttactgaagttatctgtgttaatttggaccactccaggctttacagatgactcactccattcctaggtcacttgdsgccaaactgttggaagttcact

SEQ ID NO: 32593 - DNA, 188 bp, Homo sapiens
  misc_feature 31: r=a or g
  misc_feature 91: r=a or g
  misc_feature 171: w=a or t
  misc_feature 179: d=a or g or t
gtattttccagtgagagaccgcggagtgttrggtcgtgtagaagtgactgaacccagaaggtggagacgagacgttgtcccgactgcacaraggctgctctgcagctccttaaaggcgctaggcgtgacccgcaccaaggccgggatcgggaccaccgtgcccgggtaccwgcactgcdcgcccccca

SEQ ID NO: 32594 - DNA, 338 bp, Homo sapiens
  misc_feature 14: k=g or t
  misc_feature 15: d=a or g or t
  misc_feature 39: k=g or t
  misc_feature 120: k=g or t
  misc_feature 132: s=g or c
  misc_feature 214: r=a or g
  misc_feature 226: m=a or c
  misc_feature 229: r=a or g
  misc_feature 322: m=a or c
cactctttgttatkdaagggcttccttgttttggctgtktgtactcttcagtggagaaagaaaggggcctggggaagaagggaaagcaagttttgttgttcaattggaaatagaataatkagtttgccccasactggggagatgggaggtgagctgtccatggcgtatcactagctgtaatgatagttagccctcaaaggcagagataattgaratcccctgagamggratttcaacctcaccaaatctttatcagagttataaaacagtagtgagatggactgtttggcctttaaattttaagtttttaatcacactttcmtggtggaggtagtcaa

SEQ ID NO: 32595 - DNA, 238 bp, Homo sapiens
ccctagattatctgaatggacacctcttcttgacaagggcatttcaaaactaacctgaaaaactaattcaggccatgatgggaagaggggatcagacatatctcattataacctcttcccttttagaattactgatagaacagactatttaagagtctcgtgcgaaagatttacaatctattttctccaaagcctgctccaaaaccttggtctccacaacacgttatcttaaccgcac

SEQ ID NO: 32596 - DNA, 305 bp, Homo sapiens
ttctccttttaaatgtattgggagatgagacagtagaaaatgggctggggaaacatgagatctgggtgctagttctgcactaggcaaatacatggtcttattctctgcggtttaggctgagaagtttcatctgtctggttgctaaattttctcaatgttatgtacccagaaatggacgtcacatatctcaaaacaatatttcagattggaaggaatctacctgcctgtctgtttcagaagaagagaaactgaaaaagtattccgggaagggaagttttccttttcttgactaaagagaagaccat

SEQ ID NO: 32597 - DNA, 356 bp, Homo sapiens
  misc_feature 283: n=a, g, c or t
  misc_feature 289: w=a or t
  misc_feature 290: n=a, g, c or t
  misc_feature 291: n=a, g, c or t
aagtatatagcctcatttaaaaggtaaagtatcttagaaaaagtctcaaacatggacatttccttggctatcaataggtctatactgtgataaacattatagatttaaaattcaacaaactgaacattgtcagtgtgattctggtcacataggccaaatccagccaaatgccaaaatgacactagatttagaatggaaaattttaagatcacatgtgtcaagcagtattaacctgacaaaattccagaagaggaaagaatttggataaactcttaagagttcnccatawnnggatgtgactgtgtgtttctagccaagatgatatgtgacagttctggcaataagaatatatccta

SEQ ID NO: 32598 - DNA, 347 bp, Homo sapiens
  misc_feature 347: w=a or t
tgcttcattttccccttgtttctagttttgcgtatgtttgaaaatacccataataaaaagtataaaaacagtaaactttaacatgaataaatttttgttgaaaaagaacatgagatacatgagtaaatttgagctatgtttttttgtaatgtagagaaaaaaagaatacaaagaaatatacacagtttaaaacagtggctgcttttaggtagtaagataattcatgagttttctctttaattatcatttatatatgtaaatttatatacttgcaaattttttataatgagcacttttaaatttatttttgttagtcattcaaaaattcaaatggtataagaaagatw

SEQ ID NO: 32599 - DNA, 235 bp, Homo sapiens
  misc_feature 15: d=a or g or t
  misc_feature 129: w=a or t
tagctcacttggtgdtatgtcctatattggctaaattgaaacctggaattgtggggcaatctattaatagctgccttaaagtcagtaacttacccttagggaggctgggggaaaaggttagattttggwattcaggggttttttgtgtactttttgggttttttaaaaattgtttttggaggggtttatgctcaatccatgttctatttcagtgccaataaaatttaggaagacc

SEQ ID NO: 32600 - DNA, 349 bp, Homo sapiens
  misc_feature 166: n=a, g, c or t
  misc_feature 167: b=c or g or t
actcagctgtgcgctctgatttcgtgcgcttcctcgtccttcatgttggatggccagtttttcgtttgtgcgtcatcctctacctgagaaatggtcgcttggccctagtctagacacggtgaggagctctgaggagaagaatcttgggccctagattttgaggcgnbctgggaggggcctcgtttttaaatctctcctacacccgccccttctgcccggggatggtagtttctcagagtcaacctattggcattatgtggcaaattagtcatgccctgaccaaagtatttgtcacatttattcgagaagactacctcctgctgaccctgggccagcattaaagggcaga

SEQ ID NO: 32601 - DNA, 328 bp, Homo sapiens
  misc_feature 179: w=a or t
ccgcatgatgagactcagaccttccgctgcactagaaaatctgcaacagtgtccctgagtcacttctccttagtgggcagactcgtgttagatttgtggaacccagctctctgatttactcctttttggaaaacccatggaatttcatgtataaggctttcatttgtattttaaggttwttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgac

SEQ ID NO: 32602 - DNA, 292 bp, Homo sapiens
  misc_feature 250: n=a, g, c or t
  misc_feature 267: r=a or g
taaaaaaatgccatggatatgaaagtcatttatttttcctgaaatattgatatgtcaaaccgtcagtgatgatttccacattactgctggggaaagtttatttgccttttatccacataaatgtgtgttctttaatttgttatacaatccttagcatgcagaagaaacatcctgtaagagcacatgtcatcttaaagtcaaaatgcattttatttatggcgattatttgataaaatgctattttagtggntagctatttaattcaaraacatttctataaacactgactgtc

SEQ ID NO: 32603 - DNA, 465 bp, Homo sapiens
tgtcattcagttacaagagaagcatgtcaaagatgagcagattgaacattggaagaagatagtgaaaactcaggaagaattgaaagaacttcttaataagatggtaaatttgaaagagaaaattaaagaaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtcctttgttcttttgcagtgatgtatatctctcatcaagagacagacaaatacttgattggcattttgcaaatcttgaatttgctaatgccacacctctctcaactctctcccttaagcactgggatcaggatgatgactttgagttcactggca

SEQ ID NO: 32604 - DNA, 464 bp, Homo sapiens
  misc_feature 134: m=a or c
  misc_feature 135: m=a or c
  misc_feature 177: n=a, g, c or t
  misc_feature 430: r=a or g
tataatgaagtatttgggataaaattcaagtaaatatttgaagttttctctataaatgctcccttaatttctttttaactgacaaaaatccacagttatagcttatagattcctaagtgtatcaactggcagcmmtttaccaactattcaaattaaatcttattttaataatttttnataaaagattaataaatgaagcacaaccgaattgatgcacatttgtaccagttgaatatttttaactgtcttcaatttacagaacatatgaaagtaataagacatttgtcttctataggttactaaagattagtcttacccttcatgaggtctcataaaacttaattcagaattcttaaatgagcaagtttttcattgttttaggagaaataacatcagaagaactgcaacagcggttagatggcgtcaaggracaactagcatctcagcctgacttgagagatggc

SEQ ID NO: 32605 - DNA, 220 bp, Homo sapiens
  misc_feature 134: r=a or g
  misc_feature 140: n=a, g, c or t
  misc_feature 212: v=a or c or g
tctggaagttgtatccataatttctacgtatgttccattgacaagaacttaattgtaagagttcacataatcacagggagactaattgggaatgcacccaaataattctatcactatatactggattatagagratgcangtaaaaaagtgtgtgtgtgtgtgtgtgtgtgtgtgtatacacacatatataaaactgatataactatatgavggaaggtg

SEQ ID NO: 32606 - DNA, 311 bp, Homo sapiens
cttatccatttatatgttgatggccatttgtgttgtttccaccttttggctgttgtgcataatgctgttaggagcattggtgtacagatttctgttagagtctctgctttcaattcatatgggtatggacctagaagtggaattgctggatcatatggtaactctgtttcacattttgaggaagtaccaaactgttttccacagcagctgcaccattttacattcccaccagcaatataccagggttccaatttcttcatgtcctcaccaatacctgtaatttttcatttttcttttaataatagccatcc

SEQ ID NO: 32607 - DNA, 341 bp, Homo sapiens
  misc_feature 16: d=a or g or t
  misc_feature 17: d=a or g or t
  misc_feature 116: y=c or t
  misc_feature 269: n=a, g, c or t
  misc_feature 294: k=g or t
agatcacaatgatgaddaagtaggaaatattagcagagaactaaaaacacatatataaagatacaaaacatccctgaaaattttaatatctgaaattaaaaattcacctttttacygcataggcttaacagcagaatggaagtgccagaaaagagtcagtaaacttgcagataaatcaacagaaattgtataatctgaacaacagagaagtaaatgtttgaaaaaaatagcctcagggacccttttgatatgggacaatatcaaaagtnctaacataaatgaaattattttcckagaaaatgaggagagagagaatatttgaagaaataaaaggtggggaa

SEQ ID NO: 32608 - DNA, 238 bp, Homo sapiens
  misc_feature 128: m=a or c
  misc_feature 136: r=a or g
  misc_feature 159: h=a or c or t
  misc_feature 160: r=a or g
agaaactggacttggctttacattcttaatgtacttttacttttcctcaagatatgaacttactctcttgaagctgaattttcttttactacttaaatcatttatgtatatctggtaaattatgaccmaattttgrttagatgcatacagtaaattgahrtacacacttggtacactacgggattgttgtgcttttgtttggttttagttggaaataaggtttgatgtagatggcgat

SEQ ID NO: 32609 - DNA, 179 bp, Homo sapiens
gatgatctgttatcagtgatctttggtattgctattgtgattgttttggggcaccacaaactgcacccatataagacagcaaacttaatcaataaatgttgagtatgtactaactgctcaactggccaggcattcccctttctctctccctctcctctggctcctattccctgagacct

SEQ ID NO: 32610 - DNA, 266 bp, Homo sapiens
atcagcatgatggtccgcctaacgtgaggggagggggcctggcccaccttagctgcagaacgcatcactgacttgggaaatgaagcctcaagatagttccccggggaggagcagtgttctcagacttctgtgacgcttctagactcaagctttcagagagactcccatgacagcagccgggcacctggctcactgtgttcatcatgtgtgtgctcgtgtgttctggaatcctcccaggaagattccgccttcaggtggcccacaca

SEQ ID NO: 32611 - DNA, 166 bp, Homo sapiens
aatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagt

SEQ ID NO: 32612 - DNA, 169 bp, Homo sapiens
  misc_feature 23: m=a or c
ccgaatagaaagggagaaaaggmcattctctcttctgccattctctctgtgtacagattaaacatttcctttggtcttgatgaactgttaggtcagtttacctcaaactgttttttggcctaaggaaatctgttctctggccttttgaagttacattcagagaccgtgc

SEQ ID NO: 32613 - DNA, 466 bp, Homo sapiens
  misc_feature 298: y=c or t
  misc_feature 311: h=a or c or t
  misc_feature 312: n=a, g, c or t
  misc_feature 313: b=c or g or t
  misc_feature 350: r=a or g
  misc_feature 351: k=g or t
  misc_feature 421: r=a or g
atccttctaataatgaacagaccaataatgtcttaagagagaaaaagaacaatcttttcctttttgctgtttctggagagagctgtttgaatttggaaacccatgttggctgtcccaaatatgagatttgggcatctttcttttgtggtggggatgggttttggccactgaaagcagaatgcgctggcccggaagagaagtccacgagatgtctaagaaaggcagtaggccccaaagacaaagacgagaagtacatgaagatgcccacaagtaagtcagcccaattctgagacgaagyctgacatcaccahnbcgcctctgacaaagtcagaacagcttctgaggatagrkgaccatgatttcagcatgaggcctggctttggaggccctgccattcctgttggtgtggatgtgcaggtgragagtttggatagcatctcagaggttgacatggactttacgatga

SEQ ID NO: 32614 - DNA, 464 bp, Homo sapiens
  misc_feature 176: b=c or g or t
cattcatttaacgaatatttgtgaggcagcctgtgaagttgccttagaatctgggccaggtagtgagatcagtacgattctaccctttttctcctaaagtctgaagtcaaaggaggcaacttcaaaataaatgaaggtatctatgatgggctgagtgttgagagtttgcaccaggbacagctcagagaacagctgcgtggggacaggaactatctgggtgagcagattgtccacagataattcaaagtcatcaaagttcaaaggtctgtgagctgtgcttgtttagggattcattttcagtgtctctgtaataagttttgaactgatggctgttagggtttccaaaggacagaaccttgccttctttatgaaatggaataattttattgataatttctacatctgataaacctcgtgaacgtgtgatctgagctaacttcctgatactggctgcagctttgctc

SEQ ID NO: 32615 - DNA, 341 bp, Homo sapiens
  misc_feature 333: n=a, g, c or t
  misc_feature 334: n=a, g, c or t
tatacacctctctacaaaagcaatttttaatgaaggttagtggaattgttaaaaatctgagaggaatgatgactggaggtgtttggggtttttttctgtattcattttttaatgagaaaagttttaaatgtagtacaggttagacccaactactaccttactattataggacgattctatgtttctgttaaagtattcaagtagctttctctgggggaaaaagtaccacttggacacttaaaggaattgggatttttgtctactttggataaggcagttgacttcttaagtaaaagcaatagtgtaaaatgtcattttgtttggaatgttaanngagcagt

SEQ ID NO: 32616 - DNA, 185 bp, Homo sapiens
  misc_feature 139: w=a or t
aaattggcgattattcctggtggaggtatgagtagttcacgcccattcctcaaatccttgatttggtcctagaaacagggcataaggcaaaatcatgttaattggaaaggcaacattttgcgtaaagagacaatggcawattgtttgcatccctagcaaaagtccccaattcaagttacaggcga

SEQ ID NO: 32617 - DNA, 204 bp, Homo sapiens
  misc_feature 7: s=g or c
  misc_feature 13: s=g or c
  misc_feature 14: r=a or g
  misc_feature 90: s=g or c
  misc_feature 91: w=a or t
caaagasaaaccsraaatacatgagtaaggaatcctgctcatcaactatctttatatgttaatcacattatactagtatttatttcaaaswgatatatggactggaaggatacactttataatagagtacctcttgaaggggttgagtggtcaaagaaggaatattacttttatttgtaatgttttaatatttatatgagggga

SEQ ID NO: 32618 - DNA, 285 bp, Homo sapiens
  misc_feature 125: y=c or t
  misc_feature 128: k=g or t
  misc_feature 140: v=a or c or g
  misc_feature 141: m=a or c
  misc_feature 205: n=a, g, c or t
  misc_feature 206: s=g or c
  misc_feature 282: m=a or c
atttagtcatagaagaagtcactgtttgtgtttcaaattttctatatataggaaattgtgctagttaattaaattggcagatttagtaaaacaaacatcttttattcacagaagtagtgtagttyacktaaattgatgcvmcttaaatctggaggttggccattataatattagcactatgtgagaaatatgtaatgctgtttansaaaatagttaatctgagaagttgaaggaaaccttctaccctgattttggagctcctgctttgtctgcagggatttmcca

SEQ ID NO: 32619 - DNA, 192 bp, Homo sapiens
  misc_feature 124: r=a or g
ctacttggggtgatccaagaaagcttcagggggaggagggcttggctttgaagcgaggatgagagtccctgtggccctctcctgagccaggcttttttctctcccaggtatgtgggagctggtraacgctgcctgtaacttcgagccacacgagagcttcttcagcctcttttcggacccccgcagcaccac

SEQ ID NO: 32620 - DNA, 330 bp, Homo sapiens
  misc_feature 115: r=a or g
tgcagtattttatttttgaaaattaccaaaacaggccgaacacagtggctcatggctttaaccctggcactttgggagggcgaggcaggcagatcacttgaggccaggagttttragactagcctggccaacaaagtaaaaacccatttctactagaaatacaaaaaaactataacaaaaatattttcggtgaattttttcctaccaaaaagatgcataagctctgtatagtatatttttaaacttttcaaatgtaaagatgccatataaatatggaatagctgacattagttgtgaattgaaatattgctgtatgagatagagggacat

SEQ ID NO: 32621 - DNA, 344 bp, Homo sapiens
  misc_feature 14: r=a or g
  misc_feature 15: k=g or t
  misc_feature 125: w=a or t
caaattggatcagrkacctgagttcatcgagtcttgctctggtcacactttattgagtaggacattgagtgtttgtcaccatctgccattcatttttaacttctgccatctgggagggtatgttwcaggggttgtgggaaggcagggaatggataagctgtgcatttgattggtatagaaagttatgagtatacagggaggtaaaacctgcattctactcttctggagtcttctattcccttttgctttttcttctccccaacccgagggcgatgcctggacaccctacctagacctttactatccactatggtagccattagccatatgtgactatttaaatc

SEQ ID NO: 32622 - DNA, 266 bp, Homo sapiens
  misc_feature 117: s=g or c
  misc_feature 118: m=a or c
  misc_feature 135: n=a, g, c or t
  misc_feature 227: m=a or c
  misc_feature 228: n=a, g, c or t
  misc_feature 256: w=a or t
ctagggagagagcactggccctactctgggcaggaagtcaacaggggagtggagagtaatgctaagaaaacatcccccgtctttcaggagggtgaactgctttcccctgaaatcgcsmcatcctcagtttctcanaataagggaaaggagtccgcttgagctactgacaagatgaaagaactgttaaggggcctaacgagagaaagagaaaaggactaggaggagamnagtgtctttcgtgttaaggaagacaggwcgaggcgtac

SEQ ID NO: 32623 - DNA, 396 bp, Homo sapiens
  misc_feature 116: r=a or g
  misc_feature 130: n=a, g, c or t
  misc_feature 215: s=g or c
  misc_feature 216: k=g or t
  misc_feature 219: n=a, g, c or t
  misc_feature 224: k=g or t
  misc_feature 225: s=g or c
  misc_feature 235: m=a or c
  misc_feature 243: v=a or c or g
  misc_feature 354: r=a or g
  misc_feature 377: r=a or g
aattaccttaggtaattcctccactcaaaacccttcagtgacttccatgacatgaaataggaagtcattggagggtttgagcagaggaatgacctgttttaaagaggctcactcargctgctgtatgggnaatagagttgcggaggggtggcaagagaagaaatgggaagaccttctgcagtcagaaagtttctgcagtaatttagagatggtaskgangtgakstagattggamacaatggvattagaagtgtttagattcttctaagcaaaggttttaaaaactcatttttaaagaatgagttaagggccgggcatggtggctcacacctgtaatcccagcactttgggagrccagaggtgggtggatcacctgraggtcaggagttcaagacc

SEQ ID NO: 32624 - DNA, 370 bp, Homo sapiens
  misc_feature 117: d=a or g or t
  misc_feature 304: m=a or c
  misc_feature 312: b=c or g or t
  misc_feature 314: r=a or g
  misc_feature 340: k=g or t
  misc_feature 357: w=a or t
cttaagaaggtaaggagtccaagcaaaagagataatccaaggagaggctaagaagaacctccctccagaagctcagatcagttgtcctggaattcatcttgaccactctggccttgdttaataagccgccctgtgccaaatgttcttctttgccctctttcctagtttgatttattcaacataggcacatcgtagataaaacagaagaatccttgccctatggagctcacattttagtgagttaatcttacccctctcatgcatcttccccatggcatgccttccccaaaaggctactctcacmaaaaaagbgracctctaactatagtggtaaaattgkatctttcttgtgttcawtttgttcttagtc

SEQ ID NO: 32625 - DNA, 385 bp, Homo sapiens
  misc_feature 157: n=a, g, c or t
  misc_feature 158: n=a, g, c or t
  misc_feature 173: k=g or t
ctacaattaaaaaattcctaataactggaatttttcttcaatttttaaaatccttaatgcccagcaaacagcagacacataataggcaacaatgaatgtttatggaactgaactaaactaaagttctaagcagttattctttcacaacctgttttcnnttcatctcttttgtkactcttagttttcttgcctagcttattgcagcagcttttgaactgctgttctttctgtaccttgtcttttccttctttgatatggtttagctgtgtccccacccagatctcattttgaattcccatgggttgtgggagggacccagtgggaggtggttgaatcatggggactggcctttcttgtgctgttctcgtgaatggcaaatgagtct

SEQ ID NO: 32626 - DNA, 284 bp, Homo sapiens
  misc_feature 263: r=a or g
  misc_feature 264: r=a or g
cctagctttttacttttaacctatttatatcattatatttaaatcaggtgttttgtaggcaacatgtagttagtaggttcttgttttctaaatctagtctacaaatttctgctattaattggttttttacaccatttatacttcaaagcagctttatttagatataatttgcataccatacaattcacccatttaaagtgtacaatttaatggtttttattatatttagagttgggcaaccatcaccacaatctaatttaaarrcatttctatcacctcgaaat

SEQ ID NO: 32627 - DNA, 344 bp, Homo sapiens
  misc_feature 209: s=g or c
  misc_feature 210: k=g or t
ccactgaggagagggaccatttttcatgttgccagaaagttccatgagttttattgagtcttggaaattcattcagcaaatgtatccagtacatctattctagatctaggccagaaactgcccgctggtcaggatgcagatgaacaagaggtcccaggccctgtcctggagggggctcgcagcgtagacctaggaacatgccacttcaskctggtgtggttgtgattgaaggggctgaggaggtgggggctgcttggatgcccaattccagtcaattccagccgatggaaaacaggtaaaaccactttgtcagtagtggtgagaaggcttagaaacaagggagc

SEQ ID NO: 32628 - DNA, 349 bp, Homo sapiens
  misc_feature 235: r=a or g
  misc_feature 236: n=a, g, c or t
  misc_feature 296: s=g or c
  misc_feature 340: n=a, g, c or t
tatttgacagaccttttcccagaaatgaatggagtgaacttgtcacttcaaggaaaacaactgacagtgtttgttgttaatgataaaatttgagcttttaagcaaaaattagaacttagaaaacttgtatctgccaccaggagtttgacaactactttaacttaaatacttaaagaatttttttgatgagatcagtggtaatgttaatgaatgtgggctttttaaatgtcgtatrntgaacgatgttatattgcaaaatcagtacaactcagtgaaccaagattttctaaatgacsgatgcatgatgttaaaaaattattcatgtgtaaaagattcattnagagctcaa

SEQ ID NO: 32629 - DNA, 345 bp, Homo sapiens
  misc_feature 282: r=a or g
  misc_feature 283: r=a or g
aattgtttttctgtgacaatataaaattactaatgttatgtatgtcctattttaaaacacttttattagtagataatatatgtccactgtggaaaaaattatcaaattccaacagacacagagaagaaacatctatattcccatcattcaagataaatataaaaagtatgtaaatttctcaattaaaaaaatctttaaacaatagtggactaataacaacagtattctataacctgttcttttctgtaaaaaaaaatgaagaatgaacacatttacatgtcrrtcaatgtacattcacctaatatttgaatggataaacagggtatcagtaaatcataatttatt

SEQ ID NO: 32630 - DNA, 279 bp, Homo sapiens
  misc_feature 139: n=a, g, c or t
  misc_feature 221: k=g or t
  misc_feature 252: m=a or c
caaaataaaggtgtattcataatgtttgtttcatatttaacctactggtgtgcatttcatgtaaagtagttaagtatcttgaatctttcctaaatcaacaaatttcctcaaggctgaccatagccaaagcgttaaaggnaataaaagataataattcagaacaaaatcttacttctttaaaatgttttgtcatgccctgtgaacacagtaaaggtaatgckcaaatttagtatattgtatcttaaaataggmataaatactattttcagatttagcact

SEQ ID NO: 32631 - DNA, 92 bp, Homo sapiens
  misc_feature 7: m=a or c
aagtgamaatttgaagaaaatattcgaactttacttcatcaattacatgaaaagattcttggctgaattggataatagtttttaaatactta

SEQ ID NO: 32632 - DNA, 306 bp, Homo sapiens
  misc_feature 163: k=g or t
  misc_feature 164: k=g or t
  misc_feature 227: n=a, g, c or t
tgtaagattttaagcagcggggagaaaatttcattcctagcttaaaagctcaaatgttacacgagacactgagctttggttctcagaagtttatcttagtgtaaacttctactgccactaggacacaaaaggaacatctctgcagtcaacaaataagcatttkkagtatctactgagcactttttgaactattagcatctgtttcccactttggtctagtgaagatncccatgattaatattttctgcttagttcccagtcgctttctgcccagctgatcttccccgccccatatggcagcacctt

SEQ ID NO: 32633 - DNA, 124 bp, Homo sapiens
tgtgaaccacatatagtttctattgtatattgtttattttccaatcctttaaaatgtaaaagccattcttagtttgtgggccatgcaaaaacaggcacccatagaccatcatttactgattcct

SEQ ID NO: 32634 - DNA, 130 bp, Homo sapiens
  misc_feature 16: r=a or g
ataattactgattgaratgtgtaataataaaatatagtggattcgataataaactggtgtagtggaaattctaggacccatgaagaggtcctttagcaattttagattttactttgtataaacagctcca

SEQ ID NO: 32635 - DNA, 240 bp, Homo sapiens
  misc_feature 239: s=g or c
cattaaacattcactgacactaactttgtgttaaatttaactaatttagaatttcgaaagcataggataaaactttccttctgaattaaagcaaatcttgagattgtaaggcagatgggaaaaaaaaattgttatttttggcctggcacggtggatcacacctgtaatccatcccagcactttgggaggccaaggtgggcagatcacttgaggccaggagttcgagaccagcctagcast

SEQ ID NO: 32636 - DNA, 96 bp, Homo sapiens
aaataagtccacattctaggtttaaggccatcttgaaacaaatgggaggcaaatcaacattttcgtgtgtctgaagcttttaatgtaattttgttt

SEQ ID NO: 32637 - DNA, 248 bp, Homo sapiens
  misc_feature 16: k=g or t
  misc_feature 90: k=g or t
  misc_feature 108: n=a, g, c or t
  misc_feature 109: d=a or g or t
  misc_feature 158: r=a or g
  misc_feature 232: d=a or g or t
  misc_feature 247: w=a or t
taattagatgttgatkcttgctcttcaagaaagggtgatctccactctatgaaagctggagaaagcatactcaggcgttatttctatgtkctcatttttggaccttandaatgagatgatgaggctattggtatcaacatttggcaggaaggatttgrttctatcctgtgcatttgtcccagtatgtgcctagcattatgagtatcttaactcactctttctgatctctttdtctttatttcagctwt

SEQ ID NO: 32638 - DNA, 333 bp, Homo sapiens
  misc_feature 128: y=c or t
  misc_feature 131: n=a, g, c or t
tttgtcagtggtatctttttttaacttgcattttctgtttgttgctgttggggacttgagggcagagaatacccctcttcaaatgctttttctcctatcacaagagcgcattccaatgtccctgcccyttnatgcagaattatgccctgaattatcagtaataaaaatagattagcctcacctgtcttcctcttttgttttctttctgtgtttgttaagacccttgataaggaagaaaaattgtaactgataggctttctcaaaaacctcacagtattaatatataaaaatgtagttgtcttttcatttattgataacgatctaggaacccgc

SEQ ID NO: 32639 - DNA, 94 bp, Homo sapiens
  misc_feature 84: s=g or c
tttttattttcttgaatgctaacaagatgactcagggtggtgccagccaccccatcacctgtttacctggccagctctcctcasctttcagggt

SEQ ID NO: 32640 - DNA, 305 bp, Homo sapiens
aagatataaatttgaacgtggatggcatatagatggtatttaaagctattagactggatgaagtcacctgtggagggagtgtcagtagctagagaagaaggattggagactgagtccgagcataccaatgttcacaaatatggagtctgggacatcagaaagaagaagcaaagagtctaaaagggagtgggctaattcggcaagaagagtactgagagtacttacccagaagccaaagacagtgttttaaaagggataatcacatgtgtctaatgcttctgatagttccagcaggatgaggttca

SEQ ID NO: 32641 - DNA, 92 bp, Homo sapiens
  misc_feature 49: s=g or c
  misc_feature 50: s=g or c
  misc_feature 59: k=g or t
  misc_feature 69: k=g or t
gccacgctgcgggcccgggccatggccgccgccgatgccgaggcagttssggcgagggkggagcctcakcaggattgctgtgtgaaaaccga

SEQ ID NO: 32642 - DNA, 380 bp, Homo sapiens
  misc_feature 16: r=a or g
  misc_feature 17: k=g or t
  misc_feature 116: r=a or g
  misc_feature 117: s=g or c
  misc_feature 124: w=a or t
  misc_feature 125: w=a or t
  misc_feature 290: y=c or t
  misc_feature 328: r=a or g
caacagaagtggagarktgactgcagatatttgagtgtcagattttgtaaagaaggaaatgtattatatatgtgaattatttaacgtatggaacacccagtgctcatggactgcarstgggtcwwattttcggacaagttaagtgagagttccagccctgcctttctcacggggacttggataacatgtttaaggacggaaagtaacatatatttccatctttatctatgaggttcctagtctttaccaaatatgccatttcataatgtggtgttttccttgtagggaaycagtatttatgttcactccaagacctgaatttatattrtaacaacattccttcattaagtggaagtgtcccgtctacaaccgttaccctt

SEQ ID NO: 32643 - DNA, 226 bp, Homo sapiens
aatgctcggaccctcaatgaactgggtgttctctactatcttcaaaataacctggagtgagtaccatggggttaataatgaaaataattaaccattttctctttgatgcaatgctgttttacattttttgtcaagtctaaagctagaaaaaaaatgataaaaaccacgcaaaatttcatgtatgatgttatataatgagcatacacatacctaaagaccatggcgc

SEQ ID NO: 32644 - DNA, 106 bp, Homo sapiens
  misc_feature 21: k=g or t
  misc_feature 53: k=g or t
ttccttttatgcgaacacaaktatatgaggggttgtgtaaaaattatttttckcttgctgtactacaaagagatagaatcaaactgctttttttcgacatactggt

SEQ ID NO: 32645 - DNA, 235 bp, Homo sapiens
gttgcctggtaacgcccgctggaggagtcccagtgtaataaggtcccggagaagtgtcactggccctgagtgggacccggtagcccgttcgctccgcgccggcgcctgtctccgcggcttggcggctagggcaggggaaatgttgcaggaggagtcggacctctctctcattattgcccagatagtccaaaagctcaagggctccaatttgtactctcagctggaacggcagatt

SEQ ID NO: 32646 - DNA, 152 bp, Homo sapiens
ttgcttcttgaaaggttatagttaagaggtcacccagagagtccatcaggatgcaaaggaaatgtattgggaattcgtaaaccatccacttccaagaaaacttcacaggaatatttgtgagatgtctaggtaaggactaaacaagggcggca

SEQ ID NO: 32647 - DNA, 207 bp, Homo sapiens
cacatcagggaaaatggggtatctatcacctgaagcatttattctttctttgtgctacaaacaatccaattatactcttttagttattttaaaatgtacaataaatgattgttgactgtagtcaccctgttgtgctatcaaatactagatcttactgattctgtcgaactatatttttgtacccactaaccatccccacttcccctc

SEQ ID NO: 32648 - DNA, 192 bp, Homo sapiens
caacagtcaacagtactggaagctgaggcttcagaacccaggtatggaaggcagggagtttgaactatgctccttgcacagaatgggaagccaggaaaatgcaaatgtcaaactatcctacagggaagtctctataaacctccacagaactcccacaaaagacacacttagggaaaaggtatgcagcccaac

SEQ ID NO: 32649 - DNA, 302 bp, Homo sapiens
  misc_feature 30: r=a or g
cccacttcgcttgccatcacagcacgcctrtcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggcatt

SEQ ID NO: 32650 - DNA, 124 bp, Homo sapiens
tgaatgaaccaagatttcaacccagaaattgaggcttcaccacaagtgaagactggggttttcttgttttcaattattgggagttttggatttccaggaatgtgcaattgtaaaaacccagccc

SEQ ID NO: 32651 - DNA, 237 bp, Homo sapiens
  misc_feature 181: k=g or t
tggaggtatttttggttggcagatgagcatgaaatattatctcatgcttcaaaatatcacattaaaattttaattttatataaactaacttggagggaaaagaatgttttaaaaatgttgtgtattcttattgataatgttccctgattgaactctgcatcttcactggactatgtattakgcgtttactacactgattttacatttaccagcatttctcagtaaaaaaaaaaaaaa

SEQ ID NO: 32652 - DNA, 173 bp, Homo sapiens
gggagaaaatggcctggttcctgaatttgtaacttttatgaaagactttctcgtggcggtgccagggaattgctcagttgggagctccgagacagcaggcgggtgaggacggcatggtctgggcatctgcctcacaccgtgtacgacaggaacaccatttccttccatctgaa

SEQ ID NO: 32653 - DNA, 117 bp, Homo sapiens
aggtgccgctgttgctgctcgtgttgaatctagaaccgtagccagacatgggactggaggacgagcaaaagatgcttaccgaatccggagatcctgaggaggaggaagaggaagagg

SEQ ID NO: 32654 - DNA, 131 bp, Homo sapiens
  misc_feature 121: w=a or t
ctgccacactctgaagactttaagaatgtttaataattgaatgattctgtatttatatactcaaaccctggcataaaatattcttgctaattacataatgcactgcactctggtttacatwataggacttt

SEQ ID NO: 32655 - DNA, 293 bp, Homo sapiens
  misc_feature 40: k=g or t
  misc_feature 41: w=a or t
  misc_feature 113: s=g or c
  misc_feature 118: m=a or c
  misc_feature 168: b=c or g or t
  misc_feature 169: r=a or g
  misc_feature 231: s=g or c
  misc_feature 232: r=a or g
  misc_feature 233: m=a or c
  misc_feature 271: y=c or t
  misc_feature 275: s=g or c
agagaaggggcccgaatcgccgaagggcactgcttcgcckwtttaaaaaacaaagcaaaaagccccgcatctgcatcaggaaggcgcctctgcctactctgggagagagaaasggcamccctcccccttgctacgtagtcgtctgcggaggcacaaccgtggaaacgbragccgccaccaccaccaccgctcaaacctctcggcactggctggggtacagggagcggctgsrmgcgaatgggataagcgagcctccagttccccgtcttcyagascaagtggcttcagtgata

SEQ ID NO: 32656 - DNA, 218 bp, Homo sapiens
  misc_feature 181: r=a or g
taagcaagtgatgaattaataggattggtcagcagttcggagggcccatccgaaagtggaccgaaatggataggatagatgagttctccttggctgtcatagttcagtgtagagatgctcagagactaggagtcagagcacagtggacccagagggtttgacttggcagtatgatgaaaarttgtagtctgatgtgaatggtcagaagagagagacct

SEQ ID NO: 32657 - DNA, 320 bp, Homo sapiens
  misc_feature 217: w=a or t
  misc_feature 226: r=a or g
  misc_feature 235: w=a or t
  misc_feature 249: w=a or t
  misc_feature 260: m=a or c
  misc_feature 270: m=a or c
  misc_feature 275: m=a or c
  misc_feature 301: h=a or c or t
tacaaagaaaatgtcaccatctcctgtcactaccttctagagacattgattgtctgacacacttcaaactgtaccgtcatggtggtttacagaaccccaggctaagctgcctactaaagtaaaatgggttggtctcttctcaagtaaattaaggagaaagtgcccagttgaataagttcttcctcctaatttttcttaagcctgttcttcagtgagwagtgacaargtgcaggtwattaaatgggcaawtaggtagaaamcaagtattamcatamcacagaacttggtcctagctgcttthctttgttcatttgtacgtc

SEQ ID NO: 32658 - DNA, 247 bp, Homo sapiens
caagcatatgaaaaaaatgcacaacatcactagtcattagagaaatgtaaatcaaaaccacaatgaaatactgtctcatactggtcagaatggctgttactaaaacatcgaaaaataacatgctggtgaggttgtggagaaaagggaatacttatgcacggctggtgggactgtaaattagttcagccattgtggaaagcagtttggcaatttctcaacttaaaatagaattaccatttaacccagc

SEQ ID NO: 32659 - DNA, 73 bp, Homo sapiens
gaggacgggagaggagtgtgtgtgtgtgtgtgtgtgtgtgtatgtatgtgtgtgctttatcttatttttcttt

SEQ ID NO: 32660 - DNA, 118 bp, Homo sapiens
gttattaatattacaatcagttgttaaatcatcaaaaaggatcagatgtatgaagctttgtaattcacaattacatactagttttgcatgttaataatattggtgacatcctggggcc

SEQ ID NO: 32661 - DNA, 320 bp, Homo sapiens
  misc_feature 286: n=a, g, c or t
  misc_feature 287: k=g or t
  misc_feature 305: r=a or g
tgaagcaataaaaaaggaatgagctattgatacagacaaaaccatggatgaatttcaagggaattgtgctaactaaaaataagccaatcacaaaagatttcatgtgatgtgattttatttataataatattcttgaaatgacaaaaatatagaaatggagaacagattagtagtttccaggggtcagagagtagaggagggagggaggtgtgtgtgtccataaaaacgttgcgccagggatcctggtgaggaagctgttctgtatcctcattgctggtgttcacgnkaatctacatatgtgatarcatttgatggaacca

SEQ ID NO: 32662 - DNA, 260 bp, Homo sapiens
  misc_feature 119: r=a or g
  misc_feature 259: k=g or t
tacaagtttagaaaaaacaaagcaattgtcaaaaaaagttagaactattacaacccctgtttcctggtacttatcaaatacttagtatcatgggggttgggaaatgaaaagtaggagaraagtgagattttactaagacctgttttactttacctcactaacaatggggggagaaaggagtacaaataggatctttgaccagcactgtttatggctgctatggtttcagagaatgtttatacattatttctaccgagckg

SEQ ID NO: 32663 - DNA, 316 bp, Homo sapiens
  misc_feature 126: w=a or t
  misc_feature 129: m=a or c
  misc_feature 157: w=a or t
  misc_feature 159: n=a, g, c or t
  misc_feature 160: n=a, g, c or t
  misc_feature 217: n=a, g, c or t
  misc_feature 218: b=c or g or t
  misc_feature 221: b=c or g or t
  misc_feature 276: k=g or t
ccctgaatgtcttgccacccttgtcaagggtgggctgaggggaggggggcgtcccagggaccccctccctccccaacggatacctttaaccatacctcatgctggtttccagaagcctggggtgtwgtmccaagtccttatcttttcatggtccctwanngatcccctgtctctctgtgttttgcttctcccaaccctcagttcctaaatcatttcnbggbttccaaatgaccattattgatgagaaggattgtgcagcttttagtttttattttkattttcaaagccaaagggccttgtgacgcccctcttgccc

SEQ ID NO: 32664 - DNA, 247 bp, Homo sapiens
  misc_feature 14: w=a or t
  misc_feature 15: w=a or t
  misc_feature 41: m=a or c
  misc_feature 110: b=c or g or t
  misc_feature 215: d=a or g or t
gtggccgccattawwgcgaagggaaaacccgtgaattcggmttaaagggggaaaaacaccgcccgctgggcccacaaaatgggggagactacggcgtccagccagtgagbccacagtagggcaaactttaggccggcttcgcccaggaacgacacgaagacagagccagagaatggtctgagcccgcagacgccgccaccacctccgccgctgadgagactctgggcttaaggacaatcgccgctat

SEQ ID NO: 32665 - DNA, 314 bp, Homo sapiens
  misc_feature 118: r=a or g
  misc_feature 119: m=a or c
  misc_feature 125: d=a or g or t
  misc_feature 126: m=a or c
  misc_feature 182: m=a or c
  misc_feature 208: w=a or t
  misc_feature 251: k=g or t
caattacgagcaattgtctcctccaaaggcaccaattctaacagcaattcacttgggtacaattgtgtggtttggagtaagagcagcagtgaggcaaggaacttaaatctgttcctgrmtccaadmatgctttatgatacttgtcctttgtccatcttagtctctgtgtctaaaattagcamcaacatccttcccaggcatgaactgwgttggatgaaggttataagggtagaagctctctttctggtcakctcttacagtgcctagaacagaactgcaggaatgcatactttttagaatctttatgaccccaa

SEQ ID NO: 32666 - DNA, 104 bp, Homo sapiens
  misc_feature 10: k=g or t
  misc_feature 50: m=a or c
  misc_feature 53: k=g or t
  misc_feature 66: y=c or t
  misc_feature 71: y=c or t
  misc_feature 76: h=a or c or t
  misc_feature 98: y=c or t
ttaagaagtkttagagtcttggcttctcatttattatataacaaaagggmaakaaaaagtaggagygggayagtghatagctggtaaacatctcctgyaataca

SEQ ID NO: 32667 - DNA, 393 bp, Homo sapiens
  misc_feature 15: n=a, g, c or t
  misc_feature 17: w=a or t
  misc_feature 94: m=a or c
  misc_feature 100: y=c or t
  misc_feature 111: w=a or t
  misc_feature 117: r=a or g
  misc_feature 118: r=a or g
  misc_feature 121: s=g or c
  misc_feature 125: m=a or c
  misc_feature 131: w=a or t
  misc_feature 156: w=a or t
  misc_feature 162: r=a or g
  misc_feature 276: k=g or t
  misc_feature 321: w=a or t
  misc_feature 325: d=a or g or t
  misc_feature 329: b=c or g or t
  misc_feature 333: w=a or t
  misc_feature 358: b=c or g or t
tgtgtgtgtgtgtgngwtgtgtgtgttatcattaaacattagccagtaattttcgctaatactgatgttgtccacatttattctttagaaatamatagtyattgctatttwtagtgrraasccamtatttwtaagtatgtagccacattttaattwtaatgrtttgtcatttttgtgataagaataagtatactagattcttattactaggcttgcggtgaaaatgagcatcagaatttagacctctaattcaatttattattttatttacttttkttctcttgccgtgtcttatggtgctgatagacctttaattttatwtatdtatbtgtwtattttaattttgttttttgttttbtgttttgagaggaatctcgccctgtcgcccaagca

SEQ ID NO: 32668 - DNA, 355 bp, Homo sapiens
  misc_feature 108: w=a or t
  misc_feature 110: m=a or c
taaaaagtgacttaaaataagccaacagactctcccagaccacacaactagtggaatgattcctcctttttccattacttacttaatcacagtttagtttttttcttwamctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttccccccc

SEQ ID NO: 32669 - DNA, 443 bp, Homo sapiens
  misc_feature 16: k=g or t
  misc_feature 106: s=g or c
  misc_feature 182: s=g or c
  misc_feature 183: k=g or t
  misc_feature 305: k=g or t
  misc_feature 329: n=a, g, c or t
  misc_feature 330: m=a or c
  misc_feature 428: r=a or g
cattcaattaacagakatttattgtgcatttactgtgtgccatgcactaggctgagaagggatacaattgtaaagatactggctctttcttcattaaatctccagsaaagtagagaaatgaacaggtaattctgtgcagcctgtgccctggtagatgtaaatgccaagtgttatgccagtasktgaagagttttgaggtgtcttgtcgtctttcttatagcaggtaatgtttttgctgcaatttgaagagaaagagttaggagttagccacatgaagtggataagggagagaagggaagttgagkgaagcatttttacagggggcaganmtggtggaatttgtggtgaatctagggacttgcaggtaactaagcatggctgagatggtgattgggaatggagagaagggaagtctgaaagataagcaraggctggattacgaa

SEQ ID NO: 32670 - DNA, 84 bp, Homo sapiens
ttaatattgtcaaataacttgtgattgtcttgccatcaataaaataatgcatagttgtgttaaactacaggcaaaaaaaaaaaa

SEQ ID NO: 32671 - DNA, 240 bp, Homo sapiens
  misc_feature 16: r=a or g
  misc_feature 17: r=a or g
  misc_feature 109: r=a or g
taagggggaagagttrrgtgagatctaagcacactacaaaaatgactcctaaaattctgtgttccattcttttgcactcctttgggcagaagaggtcctgagaatccargaaagctagggttggtatggtctgataaaaaaggaatatcactttagggtagtggcacacatcttatccacaacactggctgtggggcgccactatgcgtgagggtattaatggtgcttttccagcgggtg

SEQ ID NO: 32672 - DNA, 307 bp, Homo sapiens
  misc_feature 124: y=c or t
  misc_feature 243: m=a or c
  misc_feature 292: r=a or g
  misc_feature 293: n=a, g, c or t
ttgggttttaaatggtagtagctagatgtagcaagatgttggccagcaggtgaaagtcccatgggaaaggtcatgccttcctcctggtggctccagaagcacaggaaattgctgttaacgtgtycttgtcatctctgacctggtcactgtggtcaagggagcacagtgctctgatgaatcaggtctaaattatgtgcctacacttggagtagggggtgggaagagtactccaaagcaaaatgmagggaccattactgcacagagtggaacaaagctaggtagtaagacactrnatgttcagggcaca

SEQ ID NO: 32673 - DNA, 432 bp, Homo sapiens
  misc_feature 117: s=g or c
  misc_feature 127: m=a or c
  misc_feature 391: s=g or c
  misc_feature 392: y=c or t
cctttgcatattttattacttgaacagaaactctgagagcagggtcgtgaccttgtcttacactgtaccccacagcatgcagcagagtgcaaggcacatgataggccatcaaaaggscattgttcamaggccgggcgtggtggctctcgcctgtaatctcaatactttgggaggctgaggtgggaggattgcttgagccctggagccctggagttcaagaacagcctggtcaacataatgagaccactgtctccacaaaaaaatttaaacattagccaggtgcagtggcgtgtgcctgtagtcccagctactcgggaggctgtgggaggatcacttgagcccgggagatcgaggctgaagtgagccatgatcgcaccactgcgatcgcagsytcaatcactgcagcctcaacctctttagtccagcctgggt

SEQ ID NO: 32674 - DNA, 168 bp, Homo sapiens
agacaaatcttttcttcttcataaaatagaaaagctgctaagaagcagattttaaagctaagttttactaaactcaattcatatttataatctgactcagatagctttctaatctggtctcacgttgaactgcccagccctaatcaaatgtgaacgaaagtagactgc

SEQ ID NO: 32675 - DNA, 446 bp, Homo sapiens
  misc_feature 16: w=a or t
  misc_feature 17: r=a or g
  misc_feature 341: s=g or c
  misc_feature 342: s=g or c
  misc_feature 343: y=c or t
  misc_feature 348: m=a or c
tatatagtgtgcacgwrataggcatacattgatttggacttttcctatgacaacttggaaggcagaaagttaagcacttaaaaatgatgtccaagggtggcagggtatttcatgaattatactgtgattgttgaattaagctaaaataaatattatcttgattttatttaccaacatttttggtaggatggaactcaagaggtagggactgaaccttggaagaacggggattggcatgaccgtgacattaaagtgatcaatcccctgacaattagcctaagtttatacagttatacagtgttaagggctcaggttgtctctccataagcaagatagaaagssyatggmaagaaataccatttccttctttgaactgaagccatttgagataaggaatgaaagagtataattttaaggcatttggtagatactgttaaaaaaagttt

SEQ ID NO: 32676 - DNA, 251 bp, Homo sapiens
  misc_feature 139: n=a, g, c or t
gtttttacacgaagttatgttagggaagattttcaattgttgtttttgtattaatttgtatggaggtgtggctagggagactaattgtaggatattttgacataagtgtaggacacttatgaattttgccttattattngtcaatcttataaaaatatatgttaagaaacttatctatatctacatctttaaaatttatgatgagggcacaactttcttaagctttctaatagtataggtcagtggcttca

SEQ ID NO: 32677 - DNA, 405 bp, Homo sapiens
  misc_feature 110: y=c or t
tatcctatctttaataaagtcctactactgaaaaacagggatttgcaatgaaaatcatagctaaataggcaggtttagaaagttcaaaatattggaagtgctagaagggytgcaacttgtaaaattgtactccccaagttcagtaggatagtagagaagtcgtgctaagttgatttcattgaaatgtcacgtctcacatcctgtggtccaaaggtactagtttgttttgtggaataattttctgttcacttgctgataagaaatttagcagtcagaagtaatttttaattaataacctttctttttaaaagttgctttatggtttacaagtaatactgatgcaaaaaggatttgttaacctaaattaagtagcacgcactttgtttacatgcttcagtatattgt

SEQ ID NO: 32678 - DNA, 161 bp, Homo sapiens
  misc_feature 117: y=c or t
  misc_feature 128: r=a or g
cagttttgttgtatttttcctcttgctcttaacaacataatgccatagaggagataaaacctctactctatcctttgtgccatgaggttcggagggcaaaagacttttttttttgcyccaggctagargagggtaagatattagaggtgagatttgttttt

SEQ ID NO: 32679 - DNA, 233 bp, Homo sapiens
  misc_feature 15: r=a or g
  misc_feature 101: w=a or t
tattatcttggaagrattgcataaggcttatgacttaaaaaaaaaaattctttttggaaacacaagcatttctttaaggatgaccggatgttgccgtatgwatttatggcacaagcaggtgttgtctaagtagtttctctgtttgcttgtcatagcagcatttggaaactcaaacatgctttcatttacataaatagtttatgaagctttgacaacaaatgtaaacagacacc

SEQ ID NO: 32680 - DNA, 216 bp, Homo sapiens
  misc_feature 127: k=g or t
  misc_feature 170: r=a or g
  misc_feature 171: n=a, g, c or t
gaatgtgctttaagcgactcaggacagagcagctgctctgtctcccagcttgcaagtgcagcctgcatttgtcactgaccactgaagtgtatgtttgtgcaaggtgagagctgggtgctttgttctkaatttggagacaaattgccaggtattgttgttgattgtgtttrntaatttggggatatttatatcaccacaaattcaggacctagacag

SEQ ID NO: 32681 - DNA, 315 bp, Homo sapiens
ttttattatctaattaactaaggatcttttaaaaaatctctgaattattttttgaactatcattgccatacaggtttgttttcttcaaccctatcggccctcctgagtctttctgtgctccggatagctcttttcttgtaacatcctcagtccttcaagaactacacactccttttaccctcttctctgagaggagaccctgctctcttcattccccctcttctagcctgtatttgctcacttcacacttctaccctcaggcacagagtcttccctcaggcccaggccacagccttctccattcctgccacggcc

SEQ ID NO: 32682 - DNA, 334 bp, Homo sapiens
  misc_feature 150: s=g or c
  misc_feature 151: n=a, g, c or t
  misc_feature 278: m=a or c
  misc_feature 306: n=a, g, c or t
  misc_feature 307: n=a, g, c or t
cttaggtggggccggggttccaaacctggcccagagactggaggccctcagagaccagattggcagctccctgcgacgtggccgcagccagccaccctgcagtgagggcgcacggagcccaggccaagtcctccctccccattgaaggcsnagtgggaacccaggagactgctgtgtgacctcagactgggctccacactcttgggcttcagtctgcccatctgctgaatggagacagcagctgctactccacctgcagctgggctaggggcggggamtgggggtgctatttaggggaacaagggnnttcaggagaaaccaggcagcaggggat

SEQ ID NO: 32683 - DNA, 235 bp, Homo sapiens
catcaagttgcacctgaagccacactgaagtgagccactacattccctagtctattcttcatccagtttggattgtgcttactgtcctacctggcacattgagggaaatgggcatttgtaacaagaaggaaaaaagagttttctgtgactttttcatgttaagttagggcaatggttgggttgtggataaggtcatgtggcagaataaactagggagcttttctttttttttttt

SEQ ID NO: 32684 - DNA, 253 bp, Homo sapiens
tgttttataagtgatttaaatgaaagatgagaagcagatggaaaggaagtacaatgtgcagtgtgtctatgtcatgcctgtatttgaacatgatcgttggaaagactgatcaaatgttatagtttagggaccatgcttacccaatgatcattcctttaaacgtaaagcttgaaatttgggaaatgacatttttacaagatggcaaaactggacttgttttgttttctaaggtgattgatatgcccgagcaccg

SEQ ID NO: 32685 - DNA, 319 bp, Homo sapiens
  misc_feature 14: k=g or t
  misc_feature 15: r=a or g
  misc_feature 115: r=a or g
  misc_feature 229: w=a or t
gaagttttacgatkrgctttaaaataatgattttataaattggtggtcacaataattttggtattactttcctccttttcccacttagcaatatagccaaatgtattcaacataraaattcatagggtctgaaattcatagctgggccaaattttttatggcaccttagttttaccataatggtcatctattacactcttcggttataaaatatacccttatttctttwgtttatagtatctttgaggaatgtttttggaaaagttaatttatattttatagggagaacactcaataaattatgttaactgtgccccct

SEQ ID NO: 32686 - DNA, 127 bp, Homo sapiens
caacacttattaacttttcagataacataatctatatatagattaagctttcagggatttggaaatctttttttctttctcttttttgtttttgttttatttttccatttcttttggtagggggggt

SEQ ID NO: 32687 - DNA, 283 bp, Homo sapiens
  misc_feature 105: m=a or c
  misc_feature 119: s=g or c
  misc_feature 120: s=g or c
  misc_feature 240: k=g or t
  misc_feature 264: y=c or t
gacacggcggagtgcggagcgcccgtaagctctagggcccgtgcaggccacaccatgaacacctccccaggcacggtgggcaggtgacccggtcatcctggccamtgcaaggctacgassaacaccgtgcgcttctggcaggcccacagcggcatctgcacccggacggtgcagcaccaggactcccaggtgaatgccttggaggtcacaccggaccgcagcatgattgctgctgcaggktaccagcacatccgcatgtatgayctcaactccaataacccta

SEQ ID NO: 32688 - DNA, 408 bp, Homo sapiens
  misc_feature 100: m=a or c
  misc_feature 101: r=a or g
  misc_feature 109: m=a or c
  misc_feature 289: w=a or t
  misc_feature 375: w=a or t
caaagcggtagatacatacaagttttccaaaattctgattttcagttgaaagcttgcattttataattggtgacaattgctgttagttgttttccttgamrtgatgggmatgctttattaatttttggaaaaatttctgccagatatccaattctgaataataattagttcttttaagtaaaaattacatttcatgaaagcagcagctagtttggctcacaggtcgaagaataatagcataaatgctttttctcaagacaacaatgctatttctgtttatgccagaagwagtactttatttgtacctccaattttatcactcagaatattaaaaacatatgtatttaatggttgagattcaaagaaaatagtttwtactcttcttcaaagacattcttaagtgaagtc

SEQ ID NO: 32689 - DNA, 417 bp, Homo sapiens
  misc_feature 108: w=a or t
  misc_feature 264: r=a or g
  misc_feature 265: m=a or c
  misc_feature 321: y=c or t
  misc_feature 350: k=g or t
  misc_feature 351: w=a or t
ccattgccatttgatagttgagggagctgaggcacagagaggttaaatatctcacctgaggcctcataattgtaaagtagtgagcctaggatttgaatccaggtcttwctcatgctaaaaatcctttgtttagctacaatatgatactgcttatcaagcaaatagcaaatgctgagatcatgtatatatgcggtgggggggtgttggagggggtggggtgtttgttgactcaggactatctaaatagctatcattgtgacatarmaatcaataatagtgatcactgatttgcagagcatgagaagctttggttgtggcttytattcttgagctcagactatcattttatkwcttctggtcaacattagtgtatacttggtggccctcaacaaagagaagaacagtgggggatccact

SEQ ID NO: 32690 - DNA, 302 bp, Homo sapiens
cctttacacaaaatgtttgcccatccctgatttagattcatggtagtctctgtgctctcaaaatattgaaaatgttaagtattctgttaagctctatgatgttggtttcaaattgagataagagatcagagttaattttgcccgtatgttaatcagaataattttaatggtttcggttgttgttctttaggactagtgacacaatagtcctttcccaaaaggagcacctcccagtcactcagattgtgatgacagacgcaggccaaccacattccgaagcagattatacactggggccacac

SEQ ID NO: 32691 - DNA, 112 bp, Homo sapiens
actaattttgttgttgttattgttttgtagagatgggggtctccctgtgttatcctcccacctcagcctccaaagtttgggactacaggaacatgcctccacacctgactga

SEQ ID NO: 32692 - DNA, 90 bp, Homo sapiens
  misc_feature 10: s=g or c
  misc_feature 11: s=g or c
  misc_feature 16: k=g or t
  misc_feature 17: w=a or t
  misc_feature 22: m=a or c
  misc_feature 41: m=a or c
  misc_feature 60: w=a or t
  misc_feature 77: m=a or c
gaccattctssgccgkwccaamacccgtcaaaggattatcmgacacgcgggtcggacggwccacatcagccggcagmccgggcgggtccc

SEQ ID NO: 32693 - DNA, 166 bp, Homo sapiens
  misc_feature 116: b=c or g or t
  misc_feature 121: r=a or g
  misc_feature 122: d=a or g or t
  misc_feature 166: w=a or t
gcaagtggaaaatcacggcgctcggcaagcaagctggaaattggcgggctgtggtgcctggtgcctgcgctgctcagcgggaggatgagtcaggagtgtagtgcccagactgggabagatrdgcctctgtgggcatcttgaagggaaatgagaagcggagctcggw

SEQ ID NO: 32694 - DNA, 270 bp, Homo sapiens
  misc_feature 106: w=a or t
  misc_feature 128: n=a, g, c or t
cacagagatctactcctgttttcttctaagagttttacacattcagatacatgatctacttttggttaatttttctgtatgatgtgaggtaggggtccagtttcawtcttttgcttaaggataatctngttttcccagcaccttgttgggaaaatactttgtatccattgaattttgacctctttgtcaaaaatcaattgactataaatatttagagtttatttcttgactttcagttctatcccattgctctagatgtccaccccacgc

SEQ ID NO: 32695 - DNA, 258 bp, Homo sapiens
attttttctagcctctgacataggaaatagtcaagtgcagtagatcttcctagggtacctctaagcataatagaaatgcatgagatgcattttcccttctgggcgtaaagtaaaatgttcagctgtaatttttttaaataaaaatcactgtatgatgtttcataattatgaggaacacataatcaatggaaagtatttacataaattttaataagaaaaaataaaaactattatagatatgatagcataaaggcgttg

SEQ ID NO: 32696 - DNA, 317 bp, Homo sapiens
  misc_feature 101: r=a or g
  misc_feature 104: m=a or c
  misc_feature 107: w=a or t
  misc_feature 124: s=g or c
  misc_feature 149: y=c or t
  misc_feature 240: s=g or c
  misc_feature 251: m=a or c
tattggaaaggaacctcgaagggtgatgaatcagctcatcgatggtgggcttaatatgtacaacttctcagggatattggcattttaaaaagagttagtgrcgmacwggaagggtttgctttasaatttcaggtatcaatgactgctayatagactggggactatttgaggggcagaaacactcagggcatcggtttccaagtattgctgcacattagaatcacctgggaccttttatcsaggttgcactmcccagatcccaagtaagctgggggcatcagcagcttttaaaaagatccccacacagttccaaaaaa

SEQ ID NO: 32697 - DNA, 149 bp, Homo sapiens
tggctgtatttttgttggattcttatatttgatggatagttctggtttgggattttagagtaggaattattatcttctcagaatttcgaaagttgttgtgttgtctcagaacttccagtgttgtgggagagaaaattaatggttccttt

SEQ ID NO: 32698 - DNA, 198 bp, Homo sapiens
tgagttagtaacatctgggatttgcttcaaatacactctgagcatccataatctgaaaatccaaaatgttccaaaatccaaaactttctgagtgccaacatgaagctcaaaggaaatgctgattggaccatttcaggtttttggattaaggactcttactgataagtataatgcaaatattccaaaatttggggggcg

SEQ ID NO: 32699 - DNA, 273 bp, Homo sapiens
aaaatattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctcctcctacaaggcaaggaatctttatattaggtttattctagcatgacccctta

SEQ ID NO: 32700 - DNA, 321 bp, Homo sapiens
  misc_feature 236: n=a, g, c or t
ataggaaaaaaaagtctcttaaagcctaagtagttaaaaatttattttcacatcgggcatggtggctcatgccagtaatcccagcgcttttagaggccaaggtgggaagatcgcttgaggctggagttggagaccagtctgggcaatacggtgagaccttgtctctaaattaaaaaaaaagaaagaaaaaaaattggccaggcatgatggctcatgcctgtgatcccagcactttnggatgccaaggcgggtggatcacctgaggtcaggagttcgagaccagcctggccaacatggtgaaaccccattagcggggcggct

SEQ ID NO: 32701 - DNA, 155 bp, Homo sapiens
  misc_feature 99: w=a or t
  misc_feature 104: k=g or t
  misc_feature 110: d=a or g or t
  misc_feature 137: d=a or g or t
ttgaattgtgtgacttgaagattaccaatgattttgaggcttttctataataaaaagaggttctaaccattatttgggaacaaagagagttttcatctwttttktcagadtcaaaaccattctgtaaaatctttgtdgtttaattaaatgtgcag

SEQ ID NO: 32702 - DNA, 320 bp, Homo sapiens
  misc_feature 87: k=g or t
  misc_feature 89: m=a or c
  misc_feature 95: m=a or c
  misc_feature 98: b=c or g or t
  misc_feature 99: m=a or c
  misc_feature 100: m=a or c
  misc_feature 110: r=a or g
cgtgatggggctggagagtcgagtccggggtctggcagccgagaaccaggagctgcgggccgagaatcgggagctgggcaaacgcgkamagggcmctbmmagggaaggaragtccgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaa

SEQ ID NO: 32703 - DNA, 246 bp, Homo sapiens
  misc_feature 89: r=a or g
  misc_feature 209: r=a or g
cgtagagtctcggcctgggcagtcacgtggtggtcactcctggatgtgctgtcctatccagcctctcacagctgccacccgggtatagrcaactggggaaagtggggccggccacagccatagccccagctagtgaccccagttagcacccaccgtccagagggctccctgcaggccaggggtcccccagcgtcaccctgttggggagrgaagaaagggggttcagaggccggtacctcccctaac

SEQ ID NO: 32704 - DNA, 178 bp, Homo sapiens
  misc_feature 92: w=a or t
  misc_feature 97: y=c or t
aatgaactacttgtgcaacaacatgaatgaatctcagcaacattatatgtatgaaagaatctagacgaagtacatacgttagaaatttatawtcctyctatttttatgaaattgaagaacagatatatctaatatgtggccagaatcggggcaggaattgtctataaaaggagcatga

SEQ ID NO: 32705 - DNA, 419 bp, Homo sapiens
  misc_feature 14: r=a or g
accatcactctagratcacagtgattttggcatggctttgtctcttttcctgactgtacccagctgttaagctacactaattactaggtgatgctgtgtaagtcatttcttggtgtccttgggggattggtcccaggacccccccgttggatataaaaatttatggatgctctagtccctcataaaatggcacggtatttgcatataccggtgcacatcctcctgtatgctttgtcatttctagattacttataatacctaatatggtgtaaacactaggtaaatagttgttatatattttttatttgtcttatttttattgtatttaatttttaagtgtttttaatctcgagtgattgaatctgaggatgtgaaatctgcagatatggagggcctgcattgttttccgtggagctttt

SEQ ID NO: 32706 - DNA, 71 bp, Homo sapiens
cccaaatccaaatttaacttcagccacaaactaattagcatgtcaccccaccaaagatttttttttttttt

SEQ ID NO: 32707 - DNA, 279 bp, Homo sapiens
aggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagagattttctaggaagatggtggcagaaaaagagaccctgagcttaaacaaatgcccagacaagatgccgaagaggaccagct

SEQ ID NO: 32708 - DNA, 72 bp, Homo sapiens
  misc_feature 15: s=g or c
  misc_feature 16: s=g or c
  misc_feature 44: n=a, g, c or t
attctttcgctgtgsscaattagctgctgccgtgccttggagtncggagtaacttggccaggctggccccga

SEQ ID NO: 32709 - DNA, 167 bp, Homo sapiens
  misc_feature 98: s=g or c
  misc_feature 102: r=a or g
ttgaactcataaaaacgaatttcttactgctgatttaaatcattagtcagaaagaccggtgtgtttaagcagccagacttgccattcttagcacttcsttgratttaacttctactcagtgttacctactggtagagtaagttcatttttttaaaatgacctgctgt

SEQ ID NO: 32710 - DNA, 372 bp, Homo sapiens
  misc_feature 210: k=g or t
  misc_feature 213: k=g or t
  misc_feature 230: k=g or t
  misc_feature 233: y=c or t
  misc_feature 271: y=c or t
  misc_feature 275: w=a or t
  misc_feature 298: w=a or t
  misc_feature 324: w=a or t
  misc_feature 344: k=g or t
  misc_feature 350: b=c or g or t
cactgtgcttattattattattttctattgtagagatggggtctcactgtgttgactaggctggttttgaattcctggcctcgggcgatcctcccgtctcagcctcccaaactgctgggattacaggtgtgaggtactgtgtccagccagaaaagattcttgatatgattttaattcttgtaaattagttgagatttgtgtttttttttkgtkgttgttgtttaacatgkggyctatcctggagaatgtgctgatgagaagaatgtttatyctgwagctgttgggtgaaatgtcctgwaaatgtctgttaggcccagttggtcwaaatctaatgtttctttgtkgatttbctgtctagatgatctgtcccga

SEQ ID NO: 32711 - DNA, 182 bp, Homo sapiens
attaagatggctccgggggcactgttgagttgaatctggaatatcttcttacagtttcggtgaaatgttaaagagtttatgggggaaaaattcttcacccttgtgactttgtctgattttaaaaatccaagagttttatgaccgagaaagctcagttaacttgattttctggaaccaatatt

SEQ ID NO: 32712 - DNA, 306 bp, Homo sapiens
caggttaagcgatgatgtttggtagtttaggtatattaaatgcatttctgacatacaatattttctacttaacaatgggtttttcaggatataaccctgttgtaaagttgaggagcatcttattttatttatttatttatttatttgaaatggagtcttgctctgtcacccaggctggaatgcagtggcacgatcttggctcactgcaacctctgcctcctgggttcaagcaattctcctgcctcagcctcccaagtagctgagactacaggtgcacaccaccatgcctggctttttttttttttt

SEQ ID NO: 32713 - DNA, 211 bp, Homo sapiens
  misc_feature 133: s=g or c
ttgtaattttggtagagaagcggttttgtcacgttggccgggctggtctcgacctcccaacctcaggtgatccagtaacctcggcctcccagcgtgcctgggaattataggcgagagacaccgtgcccagccsactttctttttcctttaccccactgatcactcctagtctcttactgatcctcttgcctaacctccatttttttttttt

SEQ ID NO: 32714 - DNA, 406 bp, Homo sapiens
  misc_feature 15: k=g or t
  misc_feature 95: b=c or g or t
  misc_feature 97: r=a or g
  misc_feature 146: m=a or c
  misc_feature 280: n=a, g, c or t
  misc_feature 343: v=a or c or g
  misc_feature 344: y=c or t
caggcgaatggcatkgagctaaagcattcacttcaaagaggaggatgcttctaggtatattgaatttggcatggggtgatgggtgagggttggabarggagatgtgttttggaccttggatgacaaggaagatggtctttccttcmggactggctcccttcaataaggaaatcattatggtggatttgagatgtttcagtttgctgatagctgacttccgtctgctctcctggaccttattctctctgccaactgcacaagtaaatctatatagatttcntcctgatgccatttgtgatatattgctccctgaaaagcattttcctgatattttatgaaaatvyttgaaattggccctaaattctggtagtagaaagagcatgaatattttcaagcaaaagcgtaa

SEQ ID NO: 32715 - DNA, 295 bp, Homo sapiens
ctctggaagggaggagggccacatatgtcaaccattctatataagctctgagtctcataatttcagagttcttctctgtagcgcagaccccactgcatatgcaggtgaattgaacatctgaccttcatcacattgtccttgggacatggaaactgactcaaggcatggtttataaggcgagagcattttgggggggccatggtgtggacattggacatggatgacgtcaggggcacgttctgtggcactggccctttcccccttgtctacgtattgaatgatatcctggtacggt

SEQ ID NO: 32716 - DNA, 202 bp, Homo sapiens
  misc_feature 93: k=g or t
cattcttttctttatgattgagtaacattctattcgttcatgtagatatgccacattttatgtatccattcacgaacagatggacatttacgkttttcccattttcttggctattatggataaggctgctgtgaacattcgtgtgcaagttttttgttgttgttggatttttttttcttttttttctctttttttttttttt

SEQ ID NO: 32717 - DNA, 241 bp, Homo sapiens
tccaactatgattatggatttgtctatttcttatttacttctgtcaatgtttgctttatatattttaaagttatataattgggtccagcagaagatgaaattgtgtttttctgattaattgactttgttggggagaaaagattttcttcgcccattgcctagattcatggctgagacccctttaacaaaagacagattaacaaaagaaatgcatgtgattttatattttattttatacaca

SEQ ID NO: 32718 - DNA, 462 bp, Homo sapiens
  misc_feature 93: y=c or t
caagaatgtcagcaggaccatgtttcttctggaggctccagggaggattcatttcctggcctgtcccagcatctagggactgcctgtgtttcyttggctggtggtcccttcctccccttcaaagccagcgattctgtgtcttctaatttctctcatgcttctctctctctgtcactgtaaagacccttgagattacattgggcccacctgaattacccagcataatctcctcattgtaagatccttaacttaatcacgtctgcaaagccccttttgccacctaaggtgacattcccagttctgtggattaggacgatgacatctttgtgggcaggaggtggcattactttgcttgccacaaggttgaaaaaaaatgttgcttaaaatggatattttagtgaaatcactgttgtaaaggttttttttgttttcgtttgttgtttgagacagagctcactcttt

SEQ ID NO: 32719 - DNA, 287 bp, Homo sapiens
caagtctggaagtggagggaatgttccattttctcctatgacatataaaaggacctggtcaatcagtgggagactgtgctgccctcgtttgtaaagttgtgaatgccatcgcgtgagtcctattgcatttcatcaaagctggggtggtgtaattagtcagatttagttggttttgaaaatggacaattagagtgagctttcatcacgtgctcctttgtacagagccagaccttctcccttgtgttccgtctcagcattatgcattccagttggtttttccccagcag

SEQ ID NO: 32720 - DNA, 124 bp, Homo sapiens
ccttcctttctttctttttcagagggagtctcgttctgtcacccaggctggagtgccgtggggccatctcagctcactgcaacctccgcctcccggtttcaagcagttcttgtgcctcaggccc

SEQ ID NO: 32721 - DNA, 218 bp, Homo sapiens
taatacatttcatttttagtagttttagtgcatcccccttccctcatctggaaatcgagctgaaggttgaaatatcatttgtaaatgtccagggtcagacagtttcctgagtcaggcttagagctgctgtgcagtgttcatccatactcccaagtagccgggaccagtcctgatttgcttacaaatctcctcttcatcaacatctccctgcttgccca

SEQ ID NO: 32722 - DNA, 262 bp, Homo sapiens
ctcatttctttttagcactgaataatattccattatctgggtatacagcagtttatccattcacctactgaaggacatcttggttgcttccaagttttggcaattatgaataaagctattataaacatctatgtgtaagtttttgtgtgacaagcaatttttaactcctttgggtaaatactaaggagtacaattgctggatcatatggtaagaatatgtttagttttgtagaaaattgccaaacggtatttcaaagcgggc

SEQ ID NO: 32723 - DNA, 396 bp, Homo sapiens
  misc_feature 171: y=c or t
  misc_feature 187: n=a, g, c or t
  misc_feature 188: b=c or g or t
caatgaacagataaatttgctataaacagtgtttataatcaacactgtttataatctataataagagcagcacagacttcttaactgagctttctgtaaacaggaacattttaataagcgataaatttttcttccctcccttcgtctgtatgtatgtatgtatgtatgtaygtatgtatctatctcnbctatctatctatcatctgtctatctatctatctatcatctatctatctatctatagtctgcctatctgctataagtaatatatttcaaaattaatatttaaaccaaaatactaaggacatattttatgtatatgtggaatgtaggggtacttaagagggatttttaatttccccacaaataatcttgttaattcaatcaatgttttat

SEQ ID NO: 32724 - DNA, 152 bp, Homo sapiens
caagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcaca

SEQ ID NO: 32725 - DNA, 353 bp, Homo sapiens
  misc_feature 306: s=g or c
tgctgatatatttcattgtccctttcttaagggtgcttaattctagcaccttgggtcaatggtatgtgtttgggttgagggtactgggaataattgttgagaattattggagcatggcgatatacaaaatagaccaaattttcattggttttgttattatttttaaatctccttcagacaatgcccgtattacctgagcccagcacaggccgctctcaccacctgtccccttggtacaccattgactagaaaatcatttgttgacattttgctttcatcctaagatttgaagtcctcaaggcagtscctgcgtccttttcatttgggcatcctcagtactcagtatgatgcct

SEQ ID NO: 32726 - DNA, 95 bp, Homo sapiens
tgaaatttttccatttttttcttttatgaatcatatttttggtgtcatatttaagaactcttgcctaactcagggtcatgaagattttcccctac

SEQ ID NO: 32727 - DNA, 244 bp, Homo sapiens
catttttcagtcttaatgatttgaggtagctcctgctaatttttgttagccatgcacaaatgcaaatggtaatgaggcttttgtgtatgtgtgtgaaattcaaaatccatccctactctattaactctgtaaagaaagttacaccgtaggagaccatagtagtctgaacaaaagggcttctattgtacaaaaccaatttccatgtaatcaagttgggcgacagagtgtttgctcttgaatggcg

SEQ ID NO: 32728 - DNA, 405 bp, Homo sapiens
  misc_feature 107: b=c or g or t
  misc_feature 108: n=a, g, c or t
  misc_feature 116: n=a, g, c or t
  misc_feature 253: y=c or t
cactaccctcattttatagatgaagaaactgaggctgggggaggtcaattaacttgctcaatttcatgcaggcaaaactaggaatcggcagacggtggttccagtgbntgcctctnaattgctacgtataaaagtgttttcttccatcaataaaagaaatcagcgaacagcctcctgtgcgtttcagtaagtgcaagccctccttgtcatcccagacctcagcctgctcattaatgggtgaggacactgaggyctggaggggactgtgacatcggagccactctcctggggtctgccactcctgtcgcctcccatacaaacctgagtggccacgtgaccctgggggagcgctacctaactgtcccaaggagaggatgatcactgctggcctcccaccagccatca

SEQ ID NO: 32729 - DNA, 369 bp, Homo sapiens
  misc_feature 129: k=g or t
  misc_feature 137: m=a or c
  misc_feature 138: k=g or t
ggtagtttggggtttaaaataacaatttcatggggaaggaactagccaaccaactcatttgatgtcaaggcaccatttattgtaggcctgtgcagtgaagcttctgatacaagtgccctcttgccatckggcagctmkgttctcaaatgcccctttggtgtttgaactctgtcaattcagtgttgccatgtgttctcctgtaaagaggttaatactttctcatttgaatctagtgaaatactccaggtaacatccatccatccccttctgccgaccctctctacccgccatgtcccctgctgtaactgcccattaatcagccctgagcttgccaataggaaaacgcatccacggggctgtgaactcaat

SEQ ID NO: 32730 - DNA, 182 bp, Homo sapiens
  misc_feature 87: v=a or c or g
  misc_feature 93: k=g or t
tatcaataggtgcctcccactaaattttcggaaagatgaattaaaaggcatttataaagatcgaatgaaaattggagcaagccttgvcgatgkttgatccaatgcaactagattcttcagtacgatttgatagtgttggtggcctgtctaatcatatagcagctctaaaagagatggtggtt

SEQ ID NO: 32731 - DNA, 316 bp, Homo sapiens
  misc_feature 119: m=a or c
  misc_feature 122: k=g or t
  misc_feature 123: w=a or t
  misc_feature 129: k=g or t
  misc_feature 201: y=c or t
cttctgttttcttttcttttcttttttttgagatggagtctcactctgttgcccaggctggagtgccctgagtagctgggattactggcacctgccaccatgcccagttaattttagtmttkwtactaktagatggggttttgccctgttggccaggctggtctcgaacccctgacttcaggtgatctgcccacctcagcytcccagagtgttattattacaggcatgagccaccgtgcctggcctggatcttctcttttctaaggaaaagccagaaattcgaattatttacttgagatctgtcaattttactttt

SEQ ID NO: 32732 - DNA, 171 bp, Homo sapiens
  misc_feature 92: r=a or g
tatggtttgggacactcaatattgcccagatggcaatccttcccaaatttatctgcagatttaagaaaatctcagtaatgcttgggggaggragtaaagagggaggactgaaatgtatatgaaatatagagagcccaaaatagctaaaaccattttaaagcagaagagcgg

SEQ ID NO: 32733 - DNA, 245 bp, Homo sapiens
  misc_feature 90: m=a or c
  misc_feature 97: k=g or t
  misc_feature 106: r=a or g
  misc_feature 148: w=a or t
  misc_feature 216: k=g or t
aaatatttcatattagggagagctctgtgctgccctttcccaaagctttggttatttgatgggaggggaagtcttctcgaacctatgtcmgaatatkccgctttgraagaggagggtttttcttgaggctagttttgtacctgctgtwtcttttagaaatgattgctttatggatttaaaaggtgacccaaatgacttttttattattattatttkttaatgctgggaggagtttgcgtatgtgt

SEQ ID NO: 32734 - DNA, 119 bp, Homo sapiens
ctgaaaagttctttttagcaatgtttttagtttgagataaatcagaagtacagtcataagcattacatccctttcctttggtaatgtttaatcattctatgaatgtttcttttgttttt

SEQ ID NO: 32735 - DNA, 288 bp, Homo sapiens
aaaaggcaattatttttagtattttccagtagatctcagctgtctggtattgtcaggctctattcatggagaggtggaatttggagagagttagttcagtgaatggtgagtgggggagggaggaaaggaaggaggaaaataaggcagggaaaaaacacagaaaggttgggtgggggagcgagaaggaaggagagaaggagagagaaaggagagaatgagaatatgagtgggagcttgtgagcttttccactctggtactattatctggcatgatggccctcaaggcaa

SEQ ID NO: 32736 - DNA, 307 bp, Homo sapiens
gtacattgttgggttcagaaatggagctttccttcaggggagtgataactctttcatctcaagttccatcctgcagaaccccagagaatcctggcttgctcttaggaatatgttgtcccacaccattttccccagcccaaggttggggcaggggcagactaagcttcccaagtagtggtatatacctaagaagggcctcttccaaccttgttttaaaattgggccctgacttccagaaacacgttatcaggtggaaacacataaaggcttagaacttagggcctgaaaatgatgcatcccagagaca

SEQ ID NO: 32737 - DNA, 217 bp, Homo sapiens
atggaaaaattagaagtggggagtggtgatgcacatacgtgctgtatggaaaacgtgttggctgacaataagatatattctaattcttaaaagtatacgtttacatagacacgtgtataattttacacacacgtaagtatgatataaaaacttagtctgttgtatttttttttcccctggttgctcttcaccacctgggtctctcacctccacctcc

SEQ ID NO: 32738 - DNA, 383 bp, Homo sapiens
  misc_feature 342: r=a or g
tgtatttttagtggagatgggatttttccatgttggccgggctggtctcaaactcctgacctcaggagcccacctcggcctcccaaagtgttgggatacagatatgagccaccacacccagcctagagtagagccatttcttgtagagtaggtctgctagtgatgaattatgtctttctgtttatctgggaatatctttttctcctttgtttttgaaggatagttttgctggattttgggaatgtttggtttacattattttagcttccatggtttctgatgaaaaatatgtgttatctcaaggatctcttgtgtgataagacacttgtgccggtttcaagrttctctttgtctttgttttttaagagtttgattgtatgcta

SEQ ID NO: 32739 - DNA, 77 bp, Homo sapiens
ctgtgttgttgaatgtagactttctttttaaggctgagtaatattccattgcatgtatattgcactttttttttttt

SEQ ID NO: 32740 - DNA, 387 bp, Homo sapiens
  misc_feature 101: k=g or t
  misc_feature 253: s=g or c
tatttgtgttttctttggaaatttggttaccgaggctggtcagggctgtggaaggacgcttaagtctggagtgttgagagcctgtggacacttccatggtkgttttgaagtcccaaagccccctcactggagtggcagagtctgaaaaactgcacactgaacccaaatgtccttccttagcagtgtggagtatactctcccccacctgtcacttttctagatgaggcttggagggtgctgaggaagggagctsgccttatcagccctcgcttctagccagtatgattctaaaactgtcctgggaaaaagaaaagaaaaccaggagccaggagcagaactgggagcctccctcttttgacagggctggggtacccatctcttagctct

SEQ ID NO: 32741 - DNA, 150 bp, Homo sapiens
caaactattatatttacagacaaagatagtaacatttgttccaggagaagatgccaagaagcaaaaaactattgccaagagaagtaattgcttattcctagttagtaaaagtgacatattctgagttgatgctttaacttttccacaccc

SEQ ID NO: 32742 - DNA, 193 bp, Homo sapiens
gagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaagg

SEQ ID NO: 32743 - DNA, 312 bp, Homo sapiens
tacatagatctaaccaatctcctcattttagtttacatgtgtcctaatctcttagacattttctgtttctctagggtaaattatagacaatttcttcaaaacctttttcagttaaaaaattctcttttcagttttgtttggtctataaggaagttagggagtggcatgaagttagggagtggcacaaagtaagtgctcaataaatatttgttaaattatggtatttatgtctttctgatatttatccaagagcctgaacatgttaacattgattaaatgtgtacacacatgaaggaacaattgagtgggtga

SEQ ID NO: 32744 - DNA, 243 bp, Homo sapiens
ttttagaaagtaaggaaataaaactttaattgaacttggaataaactcagttctgagcattccattctactctgcagttgtcatttatagacagctgtggatcataatacctatagactagatatcgttatctacttatttatattaatgacaggatatccctgggcaaacagcatcaccactgtactgtgtattcttggttgtcatgggaacctttgctgtgaaccagcagtgagagcactc

SEQ ID NO: 32745 - DNA, 157 bp, Homo sapiens
ttttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcgac

SEQ ID NO: 32746 - DNA, 355 bp, Homo sapiens
  misc_feature 103: b=c or g or t
  misc_feature 107: s=g or c
  misc_feature 125: w=a or t
  misc_feature 137: k=g or t
  misc_feature 157: s=g or c
  misc_feature 227: k=g or t
  misc_feature 231: y=c or t
  misc_feature 234: w=a or t
  misc_feature 266: k=g or t
  misc_feature 343: r=a or g
ttgagatcacctgaggcaacatagtgaaaccctgtatctagaataaattagagaaagaaaaatagtctgggcatgatggtgtgcacctatagtctccagctabtcasgagcctgaggcaggaggwtcacttgagctkaggagttcaaggatgcagtsacctgtgattgcaccactgcattccagcttggacaacagagtgagaccctgtcttaaaatttaaattttktgtyttwtggtagagatggggtctcgccctgtttccgakgctggtctcgaactcctggcctcgagcaattcttctgccttgcccttccaatgttctgggattacaggcatgagccrccacaccctagc

SEQ ID NO: 32747 - DNA, 261 bp, Homo sapiens
caaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcaagc

SEQ ID NO: 32748 - DNA, 365 bp, Homo sapiens
  misc_feature 84: r=a or g
  misc_feature 93: d=a or g or t
  misc_feature 106: r=a or g
  misc_feature 166: b=c or g or t
  misc_feature 272: w=a or t
  misc_feature 320: r=a or g
  misc_feature 330: s=g or c
  misc_feature 345: r=a or g
ctgtaacgcaaatataaatatctgcctgttaaagctaggtagaatcagtattttagatcagcttttcaggatttctgctcttgrtaaaatttdtgttttttaaaaragcattattatgattttaatataattcttaacagtgctgaaagttagcattacctaaaabtgacctcaaacttagtagtgtttgctgtaacactagaaaaaaataattacctgtaggttgctgtaggccattcagtgttctcttcttgatcctccctctgtcctcwgtatttgccatcagtacctgccttgacctcaggagcaagaagagttgrcaagaatgasccctcttgttaccgraaggcattgtgtccagatct

SEQ ID NO: 32749 - DNA, 438 bp, Homo sapiens
  misc_feature 149: y=c or t
  misc_feature 150: b=c or g or t
  misc_feature 296: n=a, g, c or t
ttttataccctcagtagaactggggataaaagtgagggcagggagaaagcagaggctccatattgttttaatttttatttattttgaggctgggttatgagactggcagtctttttttttgtattttttttgtagacatggggtttcaybatgttgcccaggctggtcttgaactcgtgggctcaagcgatctgcccatctcagcctcccaaaatgctgggattacaggcatgagccgctgcacccggccatgttttactttacaaagatttatactgaatacttggtagagccangtccctgttggaaaatattggatgatgtgataaacccaaggatatttggagattgtcagagacctgttgttgtggccttatttgaaaacttaaattagctaaagggaaacaaaatgcttatttaatagttaattagttgaat

SEQ ID NO: 32750 - DNA, 112 bp, Homo sapiens
ccctccctataagtctcattaaagctttttttgattacttttcaaagaacggtctttagtttcttatctattgcatcttttttaaaattaaattttacaattatctgtatca

SEQ ID NO: 32751 - DNA, 358 bp, Homo sapiens
  misc_feature 348: s=g or c
tcttttaaacctctgccttccaggttcaagtgattcttgtgcctctgcctcctgagtaggtgggattacaggcgtaccccaccacgcccggctgatttttgcatttttaatagagatggagttttgccatgttggccaggctggtctggaactcccgggctcaagtgttctgcccacctcagccttccgaagtgctgggattatagatgtgagccaccacgctcggcctaatttttgtatttttagtagagacagggtttcgccatgtcggccaggctggtcccgaactcctggcctcacgtgatccacctgcctcacctcccaaagtgctggaattacaagcgtgasctctgcgcct

SEQ ID NO: 32752 - DNA, 79 bp, Homo sapiens
tgagtttgaattttctagattccacatataagtgagatcatgcagtatttatcttcctgtcacaaatgacataatttac

SEQ ID NO: 32753 - DNA, 373 bp, Homo sapiens
aaaaagaacaaagctggaagactcacacttctcaatttcaaagctttgctacaaatctacagttatcaagacagtgtggtactactgtgtggacagccatagagatccatggaattgaattgagagtccagaaatagacccttaactttacagtcagttgtgtttttgacaggggtgttaggacatgaatggataaagaagatgtggtatatccatacaatgggatattattcagccattaaaccactaagctcagataaatgcatggatgaaccttgaaaacgtatggtaggtgaaagaagtcagacacaaaaggccacacgtttatttgaaattctggaataagcaaattcaggacaaggaatagatgagc

SEQ ID NO: 32754 - DNA, 322 bp, Homo sapiens
gtatttattaccatgctttcctccagagtagcatggaaataagaatgcagggaatgtgggaggagggtgttgttgaagacacctgaaggcagcacgtgcctctccttttcacctgcagctgctctcactgagctggcagtcatatgccattctttctttctttcttctttctttttgaggcggagtttcgctctgtcgcccaggctggagtgcaatggtgcaatctcagctcactgcaacctcaacctccgcctcccaggttcaagtgattctcctgcctcagcctcccaagtagctgggattacaggcacgcaccaccatt

SEQ ID NO: 32755 - DNA, 153 bp, Homo sapiens
atcaggttaccggattcgagtcagaagcggcggcaggtctgaacgcttcgagcccaacacatacagctgatacacgcagaccagatctggtcaggtcctcggaagctgagtccagagcgatgctgctgaagacagtgctcttgctgggacata

SEQ ID NO: 32756 - DNA, 421 bp, Homo sapiens
  misc_feature 383: m=a or c
agtgtctgttcatattctttgcccactttttgatggggctgcttgtttttttcttgtaaatttgtttaggttccttgtagattctcgattagcccttttcagatggatagattgcaaaaattttctcccattctgtaggtgcctgttcactgtgatgatagtttcttttgctatgtagaagccctttagtttaattagatccatttgtcaattttggcttttgttgccattgcttttggtgttttagtcatgaagtctttgcccatgcctatgtcctgaatggtattgcctaggtttcttctagggttttatggttttaggtcttatgtttaattctttaatctgtcttgagttaatttttgtataaggtataaggaaggggmcagtttcagttttctgcatatggctagccagttttcca

SEQ ID NO: 32757 - DNA, 155 bp, Homo sapiens
agcacagacacataacataatttgtccaatcaatagagtacctctgtcatcccatcccacacatagtttcctggaacaaggtaacaactcaggaaatactgtatatttcctgatactggaaatactggagtgacatgaacctaaaactcagtgcc

SEQ ID NO: 32758 - DNA, 381 bp, Homo sapiens
  misc_feature 109: w=a or t
  misc_feature 110: m=a or c
  misc_feature 142: b=c or g or t
aacaacaagatgccagtgtttggtgtttttcatttgtttttgaaacagggtcttgctctgtcgcctaggctggagtacagtgatgtgaatctcaagggatcctcagctwmttgagtagccaggactacagacattcaacacbatgcctggcaagtttttgtattttttgtagagatggcatttcaccatgttgcccaggttggtcttgaactcctggcctcaagtgatcctcccaccttggcctccagtatttgattgtcagatgagtgataaaagtcatgattggtatgagatcagacgagggaaagctctagaccaaaaagagttggaataactttatggaaggggagggatttaaatgaagccatgaattagaggtgc

SEQ ID NO: 32759 - DNA, 376 bp, Homo sapiens
taaagtgagacaaagtcacaaacatatgaatgtttacttctagtgtatgttataatttttaatacatgagtatttggtattaatttcctgtcaattatgtcatctccacaaatgcatatgaatgtgtttcaagctatccaatgagttgttaaaaattactttaatgcaaagaactacgtattttaacttattggagatcaggtttcctttttcagaacagtgataaaaaggtcacttttgagatatcccatgaaactctgactgattaacatgatatattcccttgtaaatttaggactgatatttttaaacataaaattgccaacttaaaaaaataacaaccttgttttacaacaagagttttcctggagagctc

SEQ ID NO: 32760 - DNA, 248 bp, Homo sapiens
  misc_feature 78: m=a or c
  misc_feature 92: m=a or c
  misc_feature 93: r=a or g
  misc_feature 170: k=g or t
  misc_feature 176: k=g or t
tccaaagcaggtaaagagggtagcaaagcatcggaatgatgtgctcaaaaatgcatattcctggtggggatggaggamgaaggcattagtamraggttaatcaaacgttacaacttaaccccattcatgtaggaataaatcaagtgagcagttccagacttttgcataakattttkactatgatgctgttttattaatattttctaaatttcaaaacaaaaagtgaatgtttgaaattgctgggcccc

SEQ ID NO: 32761 - DNA, 407 bp, Homo sapiens
  misc_feature 384: r=a or g
tgtgttccaggcatggccttcacaatgactatgaagtaaatactattattaaccccacttttgagtgaaagaactgaagcagatagaggtaaaggttcctcaggtggtcaggatttgaattacatcatgtattgtagccaacacactggactacaaggaatggattctctcttggtaatttcctcctctgtctccaacccatcctctcaaatcccaaaagcctaaataaatacatttatgttggtgtggtactgatttcaaggaaaggttctgtacggttctgtgtggaaacctgaaatccactatgcagagtagtgaaaccgaaatgggctacaactgtttgcctttgttccaaaacaagtgaaacaaagctttattctaaaratgaaatgtgttggttttcagtt

SEQ ID NO: 32762 - DNA, 93 bp, Homo sapiens
  misc_feature 42: k=g or t
tcaaataaagattgatgaagatactgagcagttgaaacagckgccctgttggagaccatcccagtagagaggagcatgagtatcccaggagaa

SEQ ID NO: 32763 - DNA, 71 bp, Homo sapiens
  misc_feature 15: w=a or t
  misc_feature 24: k=g or t
  misc_feature 66: r=a or g
  misc_feature 70: w=a or t
agacataatttagawtaaaggtakatctcatcagaattttgcccatggtgtaaaatattttgcatraggwa

SEQ ID NO: 32764 - DNA, 398 bp, Homo sapiens
  misc_feature 208: k=g or t
cctcctgggctcaagggattcttttgcctcagtagctggaatggcagtcacacaccaccacacccagctaattttttaatttaatttttatttttttttgtagagatggggtctcactatattaactagacttgtcttgaacttctggtgtcaagtaatcctcccaattcagcttcccaaagtgctgggattatagatatgaacctcktcctgttttcaagttcactattgtttttcctctaccgtttccagactgcgaaggagagttatttctgattcaaattttttatttctggattttcccatttggctctttttaatagtttctgtgtattcactgaagttccccacctctccatgcatgttgtccacattttccagtaaattctttagcattt

SEQ ID NO: 32765 - DNA, 98 bp, Homo sapiens
tatcttggggaccagctaagtctctgcagtagtgtgaaattccaaatggttgttttatcattggtttggtttaccaaaaaaaaggcagggaaaaaaaa

SEQ ID NO: 32766 - DNA, 295 bp, Homo sapiens
cacaactaattcttattaagataacacttaaactaacatttgatttctttccagaataaatacaatcctgtaaaaggtacaataacagttaacattgggaaaatatcagattgaggtgacatttatacatataaaatctttcagtgatggattactcttgtcaagcattttgctttattcagatattttcccagttgtcaccattgcctaacacaaaacagcaaagatgagtagtgtaacattgttaaatgttaagtcgtgctacacatgtgccttttctcatcctccagcacca

SEQ ID NO: 32767 - DNA, 351 bp, Homo sapiens
  misc_feature 14: w=a or t
  misc_feature 135: k=g or t
  misc_feature 322: m=a or c
  misc_feature 323: v=a or c or g
  misc_feature 327: k=g or t
  misc_feature 334: k=g or t
tagctttttgaggwattaccagctgttttccacagtgcctgtaccattttacattcccgtcagcaatatgcaagggttccaatttatccacattcttggtgacacttgttattttccattattatttaaatagcktcttaggaggtgtgaagtagtatatcattgtggttttaatttgcatttcccgaaagtcttatgatgttgagcatcttttcatgtgcttattggccatttgagtatattttttagagaatgtatgtttacgttctttgctcatttttaattgtgtttttggttattgttgcattgtaggagttttaamvttakatatatkctggatacatgcccctt

SEQ ID NO: 32768 - DNA, 177 bp, Homo sapiens
gactgggcgagtggaggctccggcggtgtcaatggctcctcctgccacggagcagcagcagaagcagcggcgacagggctgacgaggaggaggaggaaaggttcctttaaggaggaggaaaggacgacgcctctttttccccctatctcctcccttcacactcatttccccttcgcc

SEQ ID NO: 32769 - DNA, 170 bp, Homo sapiens
  misc_feature 168: d=a or g or t
cacattcctgctgccccggcttgcgcctcgcatcttccacccggggccaccgaggcgctgacaaggagtgggggaccgaagaaggaagaggcagaggaaaagctagagcggcgctactgtttaacctgaaagtctgaccggcagcccaaggctcgaaccccgtccgcdcc

SEQ ID NO: 32770 - DNA, 131 bp, Homo sapiens
  misc_feature 15: k=g or t
  misc_feature 16: k=g or t
  misc_feature 126: w=a or t
  misc_feature 130: w=a or t
gatgatagtctgatkktattactctacttgtggctataacattttctcaacaccatttattgaagatactgtcctgtctctaagaaatagtcacctttatttaaaatcagttagctgtaagtagawggawa

SEQ ID NO: 32771 - DNA, 223 bp, Homo sapiens
tttaaagaaatttactataaagagaagaaaaaagatggaatggtagctggaaagggaagtggggtcaagagaacatttattgttctcattgggttgttttattttttaaactttttgaagtaattttagatttacagaagagttgcaaagacagcgttcctctatatccttcatccagcttccccaaatgtttaacgtagttgtggtatatttatcaaaacta

SEQ ID NO: 32772 - DNA, 129 bp, Homo sapiens
gtatttctaacttaacagtatcatgtaacaatgtgaatttactctgttcaagttttgtggctatgtgctatttgtcatcctttccaggcatctggagagattaggtcaaaaggtaatagaagggaccat

SEQ ID NO: 32773 - DNA, 266 bp, Homo sapiens
  misc_feature 125: w=a or t
  misc_feature 139: r=a or g
  misc_feature 140: v=a or c or g
  misc_feature 166: m=a or c
  misc_feature 211: w=a or t
  misc_feature 212: k=g or t
  misc_feature 217: w=a or t
  misc_feature 232: w=a or t
  misc_feature 250: w=a or t
ctttcgggctaagccgccccggggactgagagttaaggagagttggaggctttactgggccacagggttcctactcgcccctgggcctccggacaaaatggggtctgcggttggtgtcctggcawaagcagggtagaarvggctacggggcgggcccagaatccgmgcctgcagagatgggagcagttgcagtgttgagggcggaagaggwktgcgwcttgttttgggaacwgcttcacaggatccaaawaggaaatgcccggcga

SEQ ID NO: 32774 - DNA, 309 bp, Homo sapiens
agttcactctcgaggaggggcccagaaggaggcttgttagctggggccagactgtgttgctgaggctgaatgttccagtcttccctcctgcaacatatcttgctctcatagttctcattgtgaagctctgaatctttcttctctctcctccctcccccatgctgcagtacatgctgtggagatccatgacttgcagagctttggccttgacaacatcaacatgacccactacatccagcacctgtcatttggggaggactatccaggcattgtgaaccccctggaccacaccaatgtcactgcacccct

SEQ ID NO: 32775 - DNA, 99 bp, Homo sapiens
gacgctgagtggggtgaggtatggggagacactgagtggggtgtgaggggtctgtgaggtgtcactgagtgtggtgagagttgtgaggaaacacagagt

SEQ ID NO: 32776 - DNA, 400 bp, Homo sapiens
  misc_feature 352: n=a, g, c or t
  misc_feature 353: k=g or t
ggtatgtcactgctttacaaaaggtaagagagaactctcctgaaacaggactgatcttttgttaggtgcgacctatcaggtacatttcctgatagagtgtttatgacaccataggtaaaaattggcatttatagacagttgagcctatagagtctttggtggttctaaccctatcattttataaactgggaaatcgaagcaagttttagagtttccaatttgtgcatgagctagttggatattactggtcgagcatccctaatctgaaaatgtgaaatctctaatgccccagtgagcatttcctttgagcaccatgtcagtgctcaaaaagttttccattttggtgacccankgagtttggatctagttttgttaagtatattcataaataccaggattt

SEQ ID NO: 32777 - DNA, 427 bp, Homo sapiens
  misc_feature 117: r=a or g
  misc_feature 277: w=a or t
  misc_feature 281: w=a or t
  misc_feature 282: w=a or t
  misc_feature 317: w=a or t
  misc_feature 323: r=a or g
  misc_feature 341: w=a or t
  misc_feature 346: w=a or t
  misc_feature 364: r=a or g
  misc_feature 395: h=a or c or t
  misc_feature 398: r=a or g
  misc_feature 402: r=a or g
  misc_feature 403: h=a or c or t
  misc_feature 405: m=a or c
  misc_feature 413: w=a or t
  misc_feature 421: s=g or c
  misc_feature 425: r=a or g
cagtgaggagtacgccaggtgtggcagcatgcacctttggtcccacctacttgggaggctgaggcaggagaattgcttgagcccagaagcttgagaccagcctgggcaacattagcraagaccccaatctcaaagggtgagagtatgctgtatgatgatatgcttgggcagtggagacaaagtctatttaaaaaatagaagaaaatgaatatatacaagttttattttttaactattctcagtaaagtacactggtgatggtattattagtattgtwattwwgagactgttgtatatgtaatgtgggataaagtcawtgagtrattatggaatataaaaawttcawcattttgtttgtccttgragaatcaggattctcaatgtggaagaaaaghagrtagrhgmtgaaatgwaatagagstaartg

SEQ ID NO: 32778 - DNA, 300 bp, Homo sapiens
ttctcattttaaaagagtcaaatctcactatgataactttgaacataatagaaaacatcttgataccctcattgaaacagtatttttaaaccatattctgggatcttgaaataaaatagtctcttatttgcttaagactaccatattggtatctccatcgtaaatatggctaaagcagtggttctcatactttagtttctatctgaatcgcctagagagtttgttaaaatagattacggggccccgccccaagagtaaatctggggtgggtccaaatatttacatttctaacaaggcctt

SEQ ID NO: 32779 - DNA, 336 bp, Homo sapiens
  misc_feature 128: k=g or t
  misc_feature 249: m=a or c
  misc_feature 302: r=a or g
tttcctaatgataggcatagatgatttgcctgggcggcaaattagcgttggctgtgtctcaggaagaagccaacaggaggaaccttattttgagtcaggttccaaagacagaaacattgtctgacatktgtttttgggcttatatgaataaatctgtacacatatatttttacgtgttttaatcgtaatatgtatactatttggaaatgtggctttttagttaacagagtgcatgttttaccccattgmacttaaacattaacttggggataattaaatgagtctgtcacttggacaggcargaattgtaccccccacaaaacccataaaccgccc

SEQ ID NO: 32780 - DNA, 221 bp, Homo sapiens
  misc_feature 138: w=a or t
  misc_feature 164: d=a or g or t
  misc_feature 167: n=a, g, c or t
  misc_feature 204: n=a, g, c or t
  misc_feature 205: r=a or g
  misc_feature 212: v=a or c or g
  misc_feature 213: m=a or c
caaataatttatgtagatactccccacttagtgggctctgcatagtgacttccttgcagagtataatatggaaaggggggaaaagagtaactttacagtggagaaatctgacagacaccagctcagccaggtgattgwggttaacatcatccatgataagcccdtgngatagcatgtatccttgatagcatcacatcatacagnrtgtgatvmgaatggct

SEQ ID NO: 32781 - DNA, 139 bp, Homo sapiens
tcctgcctcagtctcccaaagtgctggaattacaggggtgagttgctgcgtctggtgttggtgactttctagagattactttttggtttacatcattttccttgtgactatttttacttttttggggggcagggggacg

SEQ ID NO: 32782 - DNA, 441 bp, Homo sapiens
  misc_feature 441: v=a or c or g
gacttcgagatcgaggagttagaagccgctcttcacagagatgacgtggagtttatcagtgacctgattgcctgcctgcttcagggctgctatcaacgaagagatatcacgctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtv

SEQ ID NO: 32783 - DNA, 95 bp, Homo sapiens
  misc_feature 5: r=a or g
  misc_feature 28: w=a or t
  misc_feature 71: k=g or t
  misc_feature 79: r=a or g
cttcrtaatattacttttgtgatcagcwtccttgatacagtctttataagtaaataacataatatttatckaatttcaratacaatgatttccat

SEQ ID NO: 32784 - DNA, 314 bp, Homo sapiens
  misc_feature 260: k=g or t
  misc_feature 309: n=a, g, c or t
gtatctctaattcataggtgcattaagtaaccaccacgtcattattatacttagtaagataaataataatttctttcttttttctcttttttgagacggagtcttgctctgtgcctggtgaattgtcttaaagttatagttatacagtagctttgttaagtcagtatccaaacaaggaccatttattgccaatggatgtttttctcttaagccttagaaagcccttgcatagtcccctttttattttattttattttatkttttttttgagacggagtctcgctctgtcgcccaggcgagagtgcagtngcgct

SEQ ID NO: 32785 - DNA, 138 bp, Homo sapiens
  misc_feature 110: r=a or g
agctggcgccggcagcagcggaccggcgggagacggcggcttgggagctggctgtgctgcaggagctgcggcagccgccgtccttgcacctaaggaacctctgctgccarcccttcctcacttttggaaatggcaggt

SEQ ID NO: 32786 - DNA, 95 bp, Homo sapiens
agtagagacagggtttcaccgtgttagccaggatggtctcgatctcctgatcttgtgatccgcctgccttgatctcctgaagtgctgggattaca

SEQ ID NO: 32787 - DNA, 282 bp, Homo sapiens
  misc_feature 16: b=c or g or t
  misc_feature 17: r=a or g
  misc_feature 102: v=a or c or g
  misc_feature 104: m=a or c
  misc_feature 105: y=c or t
  misc_feature 222: s=g or c
  misc_feature 223: s=g or c
ccagtgtatcttggabraagaccctttgagagctcagaaaattaggagatgtggtcaacacattcttcttaatatctagtgcaaccaaagacttggccagcvamytaaaggccagcaactggaaaatgggtgtggtgtcaggtttcagacgcccccatagttgtcttcacgtcctttaatatgtgttggcatccctcaagccctgccagtttatgctctttsstttgtgaagccttcctgccctgcccaggaaaaagtaatgccatcccccatcccccaatc

SEQ ID NO: 32788 - DNA, 263 bp, Homo sapiens
  misc_feature 166: r=a or g
  misc_feature 173: d=a or g or t
  misc_feature 220: k=g or t
tcatgctcactaatgttttcttttttagtatctaatctgctgttaatcctgctcttaaatcagtgagagttccaactgtttttaatgcaggctgacagtccaggtttcagttaaccaagcaaactgttagaactgtatccagtttcttgaaagtaggtatagtgartaaagadtctttaggtaagtgcattccttttaatgacttgttgcgtctaaagtkctttcttcattgttcagcaccctcacagtccattcccaccctc

SEQ ID NO: 32789 - DNA, 271 bp, Homo sapiens
  misc_feature 147: r=a or g
attcctagagtttgagtaagccctttaacaatatttgcactgaaacgagttccattatctgaatcaatgttttttattatttcaaacctgggtacaatattttcaattaatgccttaactacattattagcagttgcatttgaaaargggaatagcttctacccagtgagtgaggtgatctactattactaataggaattttaggtgacctattgaggtatttctgtgtaatcagtttggacactatggaatggtcttagtcctggacgtt

SEQ ID NO: 32790 - DNA, 344 bp, Homo sapiens
  misc_feature 102: s=g or c
  misc_feature 107: r=a or g
  misc_feature 109: r=a or g
  misc_feature 110: h=a or c or t
  misc_feature 172: k=g or t
tagctgagtaacctagacaactatcttttttaaaaagatttttttcacaccttggcacattccccatatctgtttcttatttacaatttctagagaagctasgaaargrhttcagtagtcttgaaaaattggccacccaacagtttctgtgtcaaactgttaatatgggcakaagcagataaaatggagattgaggaacttcagtctcaacccagggcaattttccccaaatgaagagcatttaaggagaagatagaagaattgcccaggacattttttttttctcccatgggatgggggtaggaaaaagtctcttctggtggtatcaattatgtcccatttct

SEQ ID NO: 32791 - DNA, 495 bp, Homo sapiens
  misc_feature 168: r=a or g
  misc_feature 185: w=a or t
  misc_feature 230: n=a, g, c or t
  misc_feature 351: d=a or g or t
  misc_feature 352: n=a, g, c or t
  misc_feature 433: w=a or t
  misc_feature 465: r=a or g
ctgttgtctaccttttaaattgaaaagactaaattttatggtatcccattaaaaatcctatttaggtttttttcttttttgaaaagttttttttacattgatatggatgaatgccaattagtatggatcacacatttttgacagaaaaaatatgttgacttgatccaratggaaaatgattatcwtttggatatgtaacagtaaaattgttaaattagggagaagaaagnccattttctgaaaatgatttcttggacattgataatcagagatgtaagttgatagctacagagttctttgaccttgccttcgtgttatccacttggctctgaattgtaccatttcatcatdngcaagtctctggagagaaagcatgaaatgttcaacttgtttaatctcaacaattcggaaatatgctgtatatgttgaaaawaatgaggtgggcggatcatatgaggtcaggarttcgagaccagcctggctggcatggcgaaa

SEQ ID NO: 32792 - DNA, 231 bp, Homo sapiens
  misc_feature 107: h=a or c or t
  misc_feature 112: k=g or t
  misc_feature 157: k=g or t
  misc_feature 158: r=a or g
gtaaattaaacaaagcacatagcatagtgcttaatatgtgcagatccttaataaatgtttaataacaccacctcccttccacctctgaaagagatttccaaaaagahcgcakgtaactttcttatttttcccatttccattttggtaatgcagatckrcagtcccttgtttctgactatcaagttcactttcttttgacctaactcattacagtccaacaagaggcacaca

SEQ ID NO: 32793 - DNA, 207 bp, Homo sapiens
  misc_feature 154: n=a, g, c or t
atataagtggaaagtagacaatatatgcatttccagtgtcatctggcagcccatatcattttagctcaagcctgcatgtactgaagtatctatgtcaaagcaggaaggtggtgatctgtgtctcagtttctgagttgacaacaaaggccattgnattttagactgtgactttatcacaaagagatactgtatattggagaggaccga

SEQ ID NO: 32794 - DNA, 150 bp, Homo sapiens
  misc_feature 146: y=c or t
agacaagatggcgacgtccgtggggcaccgatgtctgggattactgcacggggtcgcgccgtggcggagcagcctccatccctgtgagatcactgccctgagccaatccctacagcccttacggaagctgccttttagagcctctygcac

SEQ ID NO: 32795 - DNA, 229 bp, Homo sapiens
  misc_feature 18: r=a or g
attactaaactgttaagraatgccccatatcatttttgtatctaggaaagaaaaaaatcagtttcatactgttgtcatctgtcagaaatgctcattttattttgaatttaaatgtggcttttgaagtacctagttaccttgaattcctggtgaccacatgtttttatctggaaaacctggagaaagttatctgtcccatctgccctgcttgtttttttttttttttttt

SEQ ID NO: 32796 - DNA, 385 bp, Homo sapiens
acagtcccctaggaacaaaaagtcgctgcagaaaatcatctcgcgattgagctgagcctgaggctcggggggacacctaaacaattgaaacaaagagggaaacgcaggggagcccatcgcatgggcgcgggggtagcaaatcgaaagacccattcaaaatgggcctgccggaaaggcagttctaccttaagattctaaacacacttctctcctacggaagaagaggggacgctcgacaggtctcgagtgcatggtaaccgagcggacagaccccaaggctgcaggacgcaggccgccccaactccacgaggcggtcggttgaacccggagccccccgcgcagggacctcttcattttgggccctcgtcagagaaatcgggcgcgc

SEQ ID NO: 32797 - DNA, 339 bp, Homo sapiens
  misc_feature 193: w=a or t
atttgcatgcaatgtctaaatctatcttgccaccttcagtatgtttttaatcattagatgtcagctgacccttgtaggaaggcaaattggatcttggtttttaataattttaaataaatttctttattgaaagtatgtctcttgattggaaagttttctgaaacaaagagacttactaattttttttgttgtwctatttgattcttgcatctttgtcccacattttctctctttgtttctctctgtggctgttttatttttactttgatatgcttttacttctttcttatgttgttttctgtatctatacaggcatattctttgtggtacgcgggggga

SEQ ID NO: 32798 - DNA, 431 bp, Homo sapiens
  misc_feature 208: s=g or c
  misc_feature 237: w=a or t
  misc_feature 402: m=a or c
ctaaaaaaaccatgagaactgtgtttaaccagtgcttgactttgcacatactcgtgcaagaattactgccaaatttgtttctgctctctgtctccaatttccattactagtggttcttgacagaattaactgactgtctctgtgtgtgtgtgtgtgtgtacacaaatgctgaaaacatgagcctttgtgtaggggtcaaacagaagasaagagccaatattcccagaaacggagtgwtcagatttccttaaaaaatgtgcagagattgtgtttctggagtcgagggctcaagttaaaagcaaacaaaataccacaaaatatataacaatttgtttttttggaggattcgcgattctgaatttggatccagttctcttaaatacacattgaacctcataggamcatggctcttcaagtagaaatgtattaat

SEQ ID NO: 32799 - DNA, 165 bp, Homo sapiens
  misc_feature 14: r=a or g
  misc_feature 127: m=a or c
  misc_feature 133: r=a or g
  misc_feature 142: m=a or c
  misc_feature 143: d=a or g or t
  misc_feature 145: y=c or t
ttatctctactaaraaaatacaaaaattagctgggcatggtggcatgtgcctataatcccagctactcgggaggctgaggcaggagaatcacttgaacccgggaggtggagggttgcagtgagccgmgatcgrgccactgamdcyagcctggcgacagagtgaga

SEQ ID NO: 32800 - DNA, 81 bp, Homo sapiens
  misc_feature 16: k=g or t
  misc_feature 22: r=a or g
cacagctcagtattakttctaratacaaagaaggctaagaagtgttcctcggggggagctatagtagaaataattacacat

SEQ ID NO: 32801 - DNA, 236 bp, Homo sapiens
  misc_feature 156: k=g or t
ccaagactactccagttttaattttttacgattctgatatccatagagagatttttcttttgtaacacactagctgtcagttccttgaactttttcctctctaaggatcccaccttattgctacaactccttcatattcacaattgtgtgcatatkactctttgactaataccttctatctttctagctcatttcttatttcagcaatccttcaacccttctgagacctaggaccc

SEQ ID NO: 32802 - DNA, 358 bp, Homo sapiens
  misc_feature 122: s=g or c
  misc_feature 123: r=a or g
  misc_feature 148: w=a or t
tatatatataaatttttgtttgggcgaccaagatctaataattaaaacccaggtggaccatggattcagacctgcctttttatgtttttgactcttaggttcatcgtgtcccagacttcttsrcataattcgtgaaggtaaagatatwctgtgtgcgcttggcctccttttcacgcatatttcattgcctctttgatgagtggttacgaagacgttaaactacctttttgttccctggggtaataggtcagtaactatgagcgccgtctctctccatgtgagcttgtgttaatagacacttttatggtagagttgggatggggccaccaccttaaaatgagtgagcagacaaggccga

SEQ ID NO: 32803 - DNA, 270 bp, Homo sapiens
  misc_feature 17: r=a or g
  misc_feature 94: s=g or c
tgaaaaacaaacaaaaraatgatagaataaaggagattgccactggatagaaaagccagaaaatcaatcagtttctctatttgcttgtacctgsttatacgtctctctgaaaagacacttaagcaattggtaactgatctctagagggagctgagagagactgcattggttggtttctggagcccctccaagtgtgaaccataggaaggtttctcgtatatgcgaaacatgaatacaacattttttgggtcatgtaaataaagttggcat

SEQ ID NO: 32804 - DNA, 169 bp, Homo sapiens
  misc_feature 125: k=g or t
  misc_feature 126: d=a or g or t
  misc_feature 132: k=g or t
  misc_feature 133: n=a, g, c or t
  misc_feature 135: r=a or g
  misc_feature 139: d=a or g or t
  misc_feature 143: r=a or g
  misc_feature 144: r=a or g
  misc_feature 147: r=a or g
  misc_feature 152: r=a or g
  misc_feature 153: y=c or t
  misc_feature 155: r=a or g
  misc_feature 160: d=a or g or t
  misc_feature 165: s=g or c
  misc_feature 169: r=a or g
ggaacgacctttggggaaaaacgggatcatgagtcctgagccgggtggtgagggagagctctgtctggggacccggctggccgaagaggccgggatgatttggggcaatctaggtgaccatggakdggagcknarcttdgagrragracgcryarctgtdggaasgggr

SEQ ID NO: 32805 - DNA, 365 bp, Homo sapiens
  misc_feature 15: s=g or c
  misc_feature 128: s=g or c
  misc_feature 189: b=c or g or t
  misc_feature 283: m=a or c
  misc_feature 289: r=a or g
  misc_feature 290: r=a or g
  misc_feature 330: n=a, g, c or t
  misc_feature 331: n=a, g, c or t
  misc_feature 332: k=g or t
  misc_feature 359: v=a or c or g
  misc_feature 360: m=a or c
acactggctgttgtsagcggcctctgaggtttcaggctcttggcggtgaaggtcagagtgcagacctgagaccactgctcaccgacttcagactccagtttatctgtgccccagcttcctcacttagstctcagaagacttaggctgaggcctcagaaggagatctccatcctttgtccagagcagaabaggatggccatgtcccaggtgagtttctaatttacccatactttgtttccagtgaaattgaggcaaggtttggaatctatatagcagacttgamaatacrrattatcccctcttctctggctgttttctattcaacttgannktcaacctctggtttctctgatcctccvmgtctc

SEQ ID NO: 32806 - DNA, 366 bp, Homo sapiens
  misc_feature 137: n=a, g, c or t
  misc_feature 138: y=c or t
  misc_feature 167: n=a, g, c or t
  misc_feature 270: n=a, g, c or t
ctctaaggaggagaagcccttggaggaagcagccgtggcttttctacctcagaggctttgaagacaagggaagcctttgggcaaagagaggattcccctgagtgcatgtagtaaagagctaaggcgctgtcacccanygtctgagaccaggagctcccaagtgtctnaaggggctttggtttgctttttccgttcatcctccttggagctcaaccccttggcttcagtctggacgtgtgaatcttcctttagctcaggacatttttctcntgtgatctctctgatgatttcttctcctgcatcgttccctgtatgtcctgtaggcaccacagggaatattagacttcctgcatctcttccaagcat

SEQ ID NO: 32807 - DNA, 344 bp, Homo sapiens
  misc_feature 157: k=g or t
  misc_feature 225: d=a or g or t
  misc_feature 230: w=a or t
  misc_feature 249: k=g or t
  misc_feature 256: k=g or t
  misc_feature 268: y=c or t
  misc_feature 275: k=g or t
gcacgtttatatgattcacttgagaataagattattaaatttacccttgagacaggaaggaaagttttaatgatatttcatggaggtttcttccacattattaacaacattctgattattggtgaatattcccatggctcacaaacacctgtaagtkagatctgcacggacggtgagcacaggactgtggttacccccttagccaagcaaacaactttttttttdcaggwgctaatttttgttcaggtkgcatttkcccagcgcagaytacagakggcatcacctttctgacagcaccaggccccaccctggcctcctagcaaactgagggctgcctagggttc

SEQ ID NO: 32808 - DNA, 285 bp, Homo sapiens
  misc_feature 133: k=g or t
  misc_feature 134: w=a or t
  misc_feature 245: s=g or c
  misc_feature 246: r=a or g
ccaatgcttgagggcaggaagtatccagcacaggagaaagatgtaggatgggaggctacaccagtctagtcttttcacgtttttctgcctacttcatattccagctgtgctgacagctgattagatggtgcckwctcagattaagggtagatccgcctttcccagcccactgacttaaatgttaatctcctttggcagcaccctcacagacacaccctggatcaatactttgcatccttcaatcsratcaagttgacactcagttttaaccatcacaggtgtgac

SEQ ID NO: 32809 - DNA, 89 bp, Homo sapiens
  misc_feature 10: w=a or t
  misc_feature 11: k=g or t
  misc_feature 35: r=a or g
  misc_feature 70: k=g or t
ttatttagawktataataaatataccaaaatgtarataaaatataaatgtatatcccattgggctatttkaaagtaaacactttgtagc

SEQ ID NO: 32810 - DNA, 425 bp, Homo sapiens
  misc_feature 37: s=g or c
  misc_feature 89: r=a or g
  misc_feature 118: w=a or t
  misc_feature 122: s=g or c
  misc_feature 261: r=a or g
agaatttacacgacgaatgtgggagaaagaggcggasgtgcgtcggacgttagtagaaagatgggagcggagagacgttgggacgccaraagtggaaggcaacgacacacgggcccgwgggsgcccttcagctagggagaaagagaggacgggggctggcgggcgggattagctgccggagggctgagtttccgcaggcctggtaagagttccagctctcgcatccctttgccgtgagtttgaggaggtggttggagcggrgaaatgcaccagaggggcggggccttccagttattaaattacgtcatgcaaatgaggtggctagacagaccaatccaaaggccccgggaagcgtttcgtccgcaccacgcagcgtaggcattcttcgggcagttctacctatttgcataatgtatgcaaatcat

SEQ ID NO: 32811 - DNA, 366 bp, Homo sapiens
tgcatgttaacagttggtctgtatttgcatgtaaaagtgggccaccagagaacccttattgattacttaagtgtttacattattttaaagactcctgtttaagagctttcagaattgtactgggtgaaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacaccccc

SEQ ID NO: 32812 - DNA, 121 bp, Homo sapiens
aaatctgtaaactccacaggctgggaaacacccagccaaaggagcaggtgtatcagtaataaggggaagaaaatccgagtgcggcacggggttttctccactctctggcagcccccgtcca

SEQ ID NO: 32813 - DNA, 323 bp, Homo sapiens
  misc_feature 104: r=a or g
  misc_feature 116: s=g or c
  misc_feature 125: r=a or g
  misc_feature 126: k=g or t
  misc_feature 132: s=g or c
  misc_feature 134: k=g or t
  misc_feature 145: k=g or t
  misc_feature 146: h=a or c or t
  misc_feature 151: r=a or g
  misc_feature 241: s=g or c
agcagtcacagagaggggccttcgctaagctgctttcaatccagattagggtgagccacaagaaaaattcttcagagatacgagtcgtgggcgtaaaacagcarctgttgtgtagstcacaccarkttcttsckaatctgctggkhtttaractcgtgatctgacttgtctgagagcatgccttgtggacttcaagccccagcatgagatccagtgataacagccttgcagagactacttscaacctccacaattgtataagccaggtccccgtaacaaatctcatactggttctgcttccctggttgaaatttgaatacagt

SEQ ID NO: 32814 - DNA, 339 bp, Homo sapiens
  misc_feature 119: s=g or c
acacttactgcactgctgctcatagacaaatatagcacatacaaaatgtactccttctacttaaaataaagttgagtataaagcagccacaggcaggtccttcatgaggtattacaggscgaaggcattgttactgtagatgacgatcccaggcctgttattggcactgaagacattccagtgggacaagatgtgcaggcgtttgctttctaagtctgtgaagtcttcttcaggtggagttcctagcgcaagggatcctgaatatggaatacgttctgaggcttcagctccacaagcactcctgatccaccgttagtatatttccagtggtcaatggga

SEQ ID NO: 32815 - DNA, 230 bp, Homo sapiens; identical to SEQ ID NO: 26773

SEQ ID NO: 32816 - DNA, 216 bp, Homo sapiens
  misc_feature 42: s=g or c
  misc_feature 187: k=g or t
  misc_feature 188: n=a, g, c or t
  misc_feature 207: d=a or g or t
  misc_feature 215: y=c or t
tttagggaaggaggactctgaggaggccccgagccgcggagstttcgggggaggcgcccgcgcagacgcgaggcccatagccaggaccaccacctagctgttctacagtctggggacgacggtttaaaaatttaatgccttgcatgcgatgtgcagtgggtgatggaagaacgtcctacatggcttknaaattggatttaaaaggcdaatatttya

SEQ ID NO: 32817 - DNA, 419 bp, Homo sapiens
  misc_feature 16: d=a or g or t
  misc_feature 259: b=c or g or t
  misc_feature 260: n=a, g, c or t
  misc_feature 322: n=a, g, c or t
ccaccataggcctcadagcacaccaaatgtccacttgcagattctacaaaaaaagaggttcaaaactgctcaatcaaaagaaaggtttaactctgtgagatgaaaacacacatcacaaagaggtttctcacattggttctgtctagattttatgtgaagatatttccttttataacataggtcgcaaagtgctcctaatgcccacttgcagattctacaaaaagagtgtctgtaaactgctcaatcaaaaggaagtttbnactctgtgagaagaatgcacacatcacaaagaagtttctcagaattcctctgtctagttttnatgtgaagatatttccttttccaccataggcctcaaagcgctccaagaatccacttgcagattctacaaaaagagtgtgtcaaacctgttctatcaa

SEQ ID NO: 32818 - DNA, 409 bp, Homo sapiens
  misc_feature 292: n=a, g, c or t
  misc_feature 293: n=a, g, c or t
  misc_feature 294: n=a, g, c or t
tccaaacgttaagaaaatgttctggctcctttaaagacatctgccagccacatttccccaaggaccgcggtttgaaccttctgatgtagatgagctctgacattggaaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcaaaaaggtgnnnaagaagccaaccaataaggccccccaccccaagcaggaaccccaggagatcaattttcccgacgatcttcctggctccaacactgctgctccagtgcaggagactttacatggat

SEQ ID NO: 32819 - DNA, 292 bp, Homo sapiens
acatggacaaatgacaattttccaaatgaaggtacatgtgtgacatccatttgccataatgcattgggacataaacctctgggattaactcctgcctcctgagtgggcacatgtaggacttgacactgagtacaatgttgtacaacattttttgcctgttttcatatgatatcaaatttattttttagtcctgatgcatttacatgagtcaaggcacgaagtttttatgcttttatgaatgcagatgatactagcaagtcagcttgttcatttgccttagttaaaggccctt

SEQ ID NO: 32820 - DNA, 385 bp, Homo sapiens
tgttatgcccttttatttctcttggtattgtttacagctaagatttactatatgtgaaagaatgatgggaagagaagtaattgggagtaatgagtgagttagttaatgactaggtcaggacagcttacaagcctggagctgcccatcactaaaataccaagcagcagtatgccacagcaggatcgggtgccctggggaaggtattcccattatgttgttggtgtttgaaaatgctataatgaccaaacaaaatggctcgactgactcagacttatgtccataggtttgcagtctacgttgttcaccagcagagtacaagatacctttggttttgctggaggcataaaaattctttgttcctgtcctcaggcgaaaatgggcacac

SEQ ID NO: 32821 - DNA, 421 bp, Homo sapiens
  misc_feature 310: n=a, g, c or t
  misc_feature 311: n=a, g, c or t
ttttgcctattaaactcctgctccaaactcactcgatgtgtgtgtgcatgtccttgacctcaatatctggtcgtgtgaccaagaacctcagtattcaccccagacaacaaggctggctttcattttgagggctcgtctgggatttgaaggtgacttcatcagaatggactgttgtcctctaaggaaagtctctggctgacaaacaattgcctcctcaaataccaagctttgctgctaaagggatctgcagtccagctgaaaacctgcccttgcctgagcccagccactttctcccagagaaaactggagnncctaaacatgattgtgaacaggcgcagtaagattgaaggagctaaaaacagacttgggtggatgtctgcagctgcaaagaagaatgtgtgggaacagacacagaaactct

SEQ ID NO: 32822 - DNA, 327 bp, Homo sapiens
  misc_feature 116: r=a or g
  misc_feature 117: w=a or t
  misc_feature 143: y=c or t
  misc_feature 240: r=a or g
  misc_feature 308: k=g or t
tgtagatacagacatgagtgtgcttgtgtgtgtgttgtagtccttcatctgggaaagctattgggtatcattgcagttcggttgctcccttctaagtttctgaggttcatggggarwaaaataacatgtaactgttatatgtyaatatctcgtcatctcccaagtaaaatataaaaagccaattacttttgagttattatcacagcctctgaatttagaagatggttaatttgtttttartggttccacagctttgttctaagatatgtgttttcagtgttcgtgagcatcttcgtgagttttctgtktgttttccttatcagaaaa

SEQ ID NO: 32823 - DNA, 208 bp, Homo sapiens
catacaataaaaataagcagatacacaatacctacagaaacaatagacattacaaacagacacaaggactccagatattggtattatcagacatagcctttaaaataattatacttactatattcagggagataaacaacaaggttgagaatattggcagataacttgattttttgtttaaagcagattagacataacaaaagacagc

SEQ ID NO: 32824 - DNA, 338 bp, Homo sapiens
  misc_feature 298: k=g or t
  misc_feature 299: r=a or g
ctatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgatkrcctgtagtgctttaaagtatatttttaaaagggacgtaa

SEQ ID NO: 32825 - DNA, 308 bp, Homo sapiens
cagcacactggaaggctgagacgggtggatcacgaggtcaggagttcaagaccagcctggccggcatggtgaaaccccatctctacaaaaagtacaaaatttagctggatgtggtggtacacccctgtggtcctagctacttgggaagctgaggcaggagaattgcttgaacccagaaggcagaggtagcagtgagccaagatcgtgccattgcactccagactgggcgacagagcaagactccatctcaaaacaaaaacaaaaacaaaaacacaacaaagattcctgctaactacatttctcatgac

SEQ ID NO: 32826 - DNA, 400 bp, Homo sapiens
  misc_feature 114: w=a or t
aagaagtgatcaaatgaccaagaatacctcgggtacagtgagaagtgtggtgtggttagactagagcagagttgagtttcagtgggagaagacaatgtgagatctggcagcccwtattgcacccttcctggggactttcttgcctttctaattgaaaagaaggatgcttcaaagctaatagctctagttccacacccaactcctctatcgtcagctgtgtgaaatagggcaaggtacttaaaaacagcctcaacttttcatgtgtgaagtggatattataatggcagatttgtagatgtgtttagaagatcaaatgagatgacatatttagagtacctgctggtatcccccaaattttccagttagtatttgcctttgtgtgtgtccttatcatggacca

SEQ ID NO: 32827 - DNA, 149 bp, Homo sapiens
ctcgcggcggcctcacggagatggctcttgactcggacttgtggtcgcgattggaggaaaaagcgcgggccaagtgcgaacgagatgaggctgggaacccggccaaggaaagcagcgacgctgacggagaggcggaggaagaaggggcc

SEQ ID NO: 32828 - DNA, 233 bp, Homo sapiens
  misc_feature 118: k=g or t
ataacattttctcataattcaagtaaataccatctagaagagagaagaggatgggaagattgtaaaagagacaagagtgtaaacagtcatagttttcaagatggaagatgtccatctkctctttcaaacagtagaactcacaaaaacattgactctaaggaagttgatgccatgcatcagtgggaaaatacacctttaaaagcagaaagacatagaactgaagataagagggg

SEQ ID NO: 32829 - DNA, 204 bp, Homo sapiens
  misc_feature 165: s=g or c
gtttctccatgttggtcaggctggtcttgaactcctgacctcaggtgatccacttgcctcggcctcccaaagtgctggggatacaggcatgaacccctgtgcccggcctaaatttttttgtatttttagtagagatggggtttcaccatgttggccaggatggtsttgatctcttgacctcgtgatctgcccgcctcgtctccc

SEQ ID NO: 32830 - DNA, 230 bp, Homo sapiens
  misc_feature 3: r=a or g
  misc_feature 4: w=a or t
  misc_feature 111: w=a or t
  misc_feature 113: w=a or t
carwatagttgcaatttttttctgaatattttcagtccatggttggttgaatccgtgatgcagaaccaaccagatatggaggattgactatatatgtaaaagattgaaggwtwaaccttgaattgtggagggacagaggtttgtctgttaccaacaggaaagaggataataggtaaggatgctgatgactttatagagggttggtgggaaacagttctttcgtggtgcca

SEQ ID NO: 32831 - DNA, 278 bp, Homo sapiens
  misc_feature 16: r=a or g
cttttctttttagcartctgtttaaagctttttttgtggttacctttacatattattaggaatacttccccatattcatcaccctactgcaacaaggccaatcttgttttacctgcatttttctgtatactggtttatgtcttgactgcattgaatccaggttttttgtttcactttgttttttcaaagaatacttcttaagtggtggtatttttttgttgtattacatcatgtggcaaatgatctctgtctgtgatgttatgattgatcaggtttca

SEQ ID NO: 32832 - DNA, 178 bp, Homo sapiens
  misc_feature 121: n=a, g, c or t
taatttattgttttttgttcttataaagatgataatcttaccttgcagttattgactttatattcaattatttacatcaaataatgaaataactgaaatgtacaaatgtcaaattttggangtatattcaataccaatgctgtatgagtgggctgaatccagttcattgttttttttt

SEQ ID NO: 32833 - DNA, 357 bp, Homo sapiens
  misc_feature 15: k=g or t
  misc_feature 16: k=g or t
gattgctggcatgtkkactcttccaagtacactgagatcaaatgcaaagacaaaccatcaaagaaaataactctaaaatctggacatgatatacaaagtgactgcctaaaggagctgaagagaggacataagtggatcgcctctgctgttgcatgttggcttggagaacagaagatgaggagccaaataagcaagtccttcagccccaggcttctagcacggggctgcatgtaggctatgcattctggggagtgaggagatcatgaatgctgaaaataaatgaaggaatccagaaaagcaagagtcaaagaaggcatctgcaggccaaatctctgatcaacccctgacccacatgcc

SEQ ID NO: 32834 - DNA, 85 bp, Homo sapiens
  misc_feature 52: n=a, g, c or t
ttagattcagtcttctaaaaggaacttggcctgtttgcctttcttttttctnctgtagccataatgactttgttgccatcctgga

SEQ ID NO: 32835 - DNA, 354 bp, Homo sapiens
  misc_feature 16: k=g or t
  misc_feature 208: k=g or t
  misc_feature 209: n=a, g, c or t
  misc_feature 210: n=a, g, c or t
aattattctttttgtkgttttatcgtcttatatttggccaattggagtctctccagattggctcctgtgtccttttgacataaccccgttaattctgagccttctttgatctggggcataacaagatattccaggtttacctcacattttttctccctcagatatggaattaacctcctatccaaggagctgtggttctttttaatgknngaggggtatttagaaaccaagatatatggttaaatgtgttcaagcaatagcaagttttagcttcccaattttttcttttagtattcatgaaaaatgtttaaagttcaaaaaaagttgtcattatcaatgttgtaaaccacttaa

SEQ ID NO: 32836 - DNA, 218 bp, Homo sapiens
  misc_feature 16: d=a or g or t
  misc_feature 105: w=a or t
  misc_feature 106: r=a or g
cggggatcagatttcdggctcacgagaaggtggggatgaggaagttgtcaaggcagagaggttaattagtgaaatagtgcccgattttgaggtggttggtaagawraaggtttgatctagggtaaagcgttgatagaagcgtagggagagctgtgcttactcacatttttccctaggcttaggcttcctgttggtaaagaggttgatcatggctcatt

SEQ ID NO: 32837 - DNA, 217 bp, Homo sapiens
  misc_feature 145: n=a, g, c or t
  misc_feature 151: n=a, g, c or t
  misc_feature 152: b=c or g or t
  misc_feature 163: s=g or c
  misc_feature 174: n=a, g, c or t
  misc_feature 175: w=a or t
atttatgtaggcaggtggatgccaactgccagtgcagggtggcataagttagcgttccaaagttaagctatggtgcattccaaatccattcacacttaggagaatgtacccaagagtgtggggatgttttcaattactgcatttncttcanbgaacaagaacsacaggtaagtnwgtgtgtgtgtgtgtgtgtgtgtgtgtgtgtgtgtgtgtgtgt

SEQ ID NO: 32838 - DNA, 318 bp, Homo sapiens
  misc_feature 62: n=a, g, c or t
  misc_feature 63: b=c or g or t
ttcaaagagatggataaattcctggacaaatacaccctcccacaactgagccaggaagaaanbgatttgctgaacagaccaataacaagctccgaaattgaatcagtaataaataacctaccaatcaaaaaaagcccagaacatgatggattcccagccatattctactagaagtacaaagaagagctggtaccatttttacaggaactatttgaaaatattgaggaggaggaactcctccccaactcattctatgaggccaacatcatcttgataccaaaatctggcacacacacacacacacacacacacacaccg

SEQ ID NO: 32839 - DNA, 168 bp, Homo sapiens
tgagaagcactagtctagtccatgtaaacaaaaatatatatgagataatttcagatgattacagatgctgtcacgagaagacaaaactataatggccagagagtgggaggaggacgagtaattgaggatggtaagtgaaagcatcagagggagtgtcctgtgggccga

SEQ ID NO: 32840 - DNA, 429 bp, Homo sapiens
  misc_feature 217: s=g or c
  misc_feature 341: n=a, g, c or t
cactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgcsagttcagtcttttcaaaatgagggagaaacatttgcctgccttgtaataacaagactcagtgcttattttttaaactgcattttaaaaattggatagtataataacaataaggagtaagccacnttttataggcaccctgtagttttatagttcttaatctaaacattttatatttccttcttttggaaaaaacctacatgctacaagccac

SEQ ID NO: 32841 - DNA, 282 bp, Homo sapiens
  misc_feature 108: r=a or g
  misc_feature 109: n=a, g, c or t
  misc_feature 111: r=a or g
  misc_feature 196: k=g or t
atctcagcattttgggaggccaaggtaggaggattgctagagctaaggattttgagaccagccttggcaacatagtaagatctccatctctacaaaaaaataaaaatrnaraattagctgggagtggtggcatacatctgtagccccagctcctcaggaggctgagctgggagggttgcttgagccccggaggtakaggctgtagtgaaccatggttgtgccactgcactccagcctgggtgacagagcagagcaagacctgtttcaaaaaaaaaaaaaaaa

SEQ ID NO: 32842 - DNA, 179 bp, Homo sapiens
tacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccct

SEQ ID NO: 32843 - DNA, 76 bp, Homo sapiens
ccttttgccttaagttgagaggaggtcaactttagctactgtctttggtttgagagccatggcaaaaaaaaaaaaa

SEQ ID NO: 32844 - DNA, 162 bp, Homo sapiens
  misc_feature 50: s=g or c
cggaaagtactttccctgccctggagtgccaaggagtaccgacagcgaasctactggaaaaagaactgcttttcttcgcttatgatgtttttggaattccctttgtggatccggattcatggactccagaagaagtgattcccaagagattgcaagagaaac

SEQ ID NO: 32845 - DNA, 293 bp, Homo sapiens
  misc_feature 100: w=a or t
  misc_feature 143: y=c or t
  misc_feature 146: y=c or t
  misc_feature 153: w=a or t
  misc_feature 155: k=g or t
  misc_feature 227: k=g or t
  misc_feature 234: y=c or t
  misc_feature 250: k=g or t
tccatatgtaaatatttagatcttatgcattattttcaattctctgacttattttttatttatccatgggtatttaggttgttccaatttttttttttgwagttaccaacaatactttggtgaacaaggaaccatgtttcgtyctycttgtawakgtatgcaggaatttctctaggatataaacaacttacctaaaaaatattaaagtaagaaagtttcaatattgkgtactcycattctttaaaaatckggtccacataacaaaagtatgttctccctcatttccccccatt

SEQ ID NO: 32846 - DNA, 342 bp, Homo sapiens
  misc_feature 281: d=a or g or t
  misc_feature 340: n=a, g, c or t
atggaactgttcttgatgactgtcactggtggctccctccatagccatttgtggaatttagagtgagattagagttgggagatagtctcctgccgtcttgactctactttggcattggagttagtgtcaaagggaaggaatccagaaaccaccagtagggtagaaagtggggagggggagtggaatagaaatgaatgatgaggacatatgtgggtccctcatcttggagtgcaacaaagagcaaatggttagctctaacgttaaatctgagtggctctcadatgttttcttaacagatggcatctgagcgagaaggctctggaagttctggcactggggnac

SEQ ID NO: 32847 - DNA, 197 bp, Homo sapiens
aatagtgtgatgtaaatatataggaataaacttctgtgagtgtgagaatactaaaaaccggtatggattagtgccataagaagcaaataccagaatgtgcttaagcttgtaaaaagggtaaaggacagcaataaggcttttaagattagtatgagaacaaaaataggagaggtaagcctgaagattagaacggacga

SEQ ID NO: 32848 - DNA, 142 bp, Homo sapiens
gaaagaaatgtcaaggttgaggtgtctttgagaggagtttgtttacatgcaaagtattttcacctacgtgaggacccagtgctggatggaggagagagaaggaggctggagcaagcccaggtctatacttacttcagctgca

SEQ ID NO: 32849 - DNA, 273 bp, Homo sapiens
cagaaagtgaaagaactgatgtaataaaaggttgatttggttggttcccatgaaagttagtaagatgcccttttaaatataaggatcagtgctttgttctgcagcagagtttgctgataaatgtctgttggattctttttggatttctttaattaatttgtaagtaaccaagataattattttcccccttgctctctatgttaatacgtagctataaagcaacagttggttttcttatcctttgataaaagcatcccataaaatataaagtat

SEQ ID NO: 32850 - DNA, 273 bp, Homo sapiens
catggatattttggtttctagtttttggctcttatgaataatacctctgtgagtgcccacacacactttttatgtagaaatgtttccctttctcttggcatatgcgtaggggaggaatttctgggacattcattatttatgttttaaccttttggaggaactgccagactgttttacagtggctgccccattttacattgctggacatatgagggttccagtttctccacatctttgccgacaattgttgtttgtcttttagatgatagcaaa

SEQ ID NO: 32851 - DNA, 275 bp, Homo sapiens
agcttgttactctttgttgctgagtagtatcccattgtatatgtcagtttgtttaaccatccacctgttgaaggacatatgagctgatttcagtttggggatattacaaataaaggtgctatgaatatgcattttacagtttttttgtgtgaacataaattattattcttctggaataaatgtccaagagtgcaagtgcaagattgtatggcaatttcatgtttagttttataacacactgccaaactagctgtaccattttgtatcccttcaat

SEQ ID NO: 32852 - DNA, 276 bp, Homo sapiens
  misc_feature 276: w=a or t
tactgttatttaaaatgcctttaacctgtcaacagagagtaatgaggaaagctttaaagtaccttaaaaggcattagtggcaaacctgataaaattttttaaaaaatctgtggttaatagtattgtaccaatgttaatttcatacttttcataattatactgtggttatataagatgttaatattaagggaaactggaggaagaatatatgggaactctttattttcacagcttttctataagtctagaactgttttagaataaaaattaaacacw

SEQ ID NO: 32853 - DNA, 250 bp, Homo sapiens
  misc_feature 114: r=a or g
ttaaagattataatcataggccaagtgtgtggctcacgcttataatcccagcactttgggaggcccgaggtgggaagatcgcttgaggccaggagttaaagaccagcctggggraatggtggtgagactctgtctctacaaaaaatttaaaagctggatgtggtggcacatgcctgtagtcccagttactcgggagggagtggcaggaggatcacttgagcccaggcgttccaccactacactccaatgt

SEQ ID NO: 32854 - DNA, 109 bp, Homo sapiens
taatgttaaaagctgctttttttggctttttgcatatctagtataataggaagtgtgagcaaggtgatgatgtggctgtgatttccgacgtctggtgtgtggagagcaa

SEQ ID NO: 32855 - DNA, 75 bp, Homo sapiens
gagaagagatgttgtgttcttaccacaaaatttattactatgtgagagaatgcatctgttaattagctagttcta

SEQ ID NO: 32856 - DNA, 275 bp, Homo sapiens
  misc_feature 16: d=a or g or t
  misc_feature 108: w=a or t
  misc_feature 117: w=a or t
  misc_feature 124: r=a or g
gagatggttgtttaadaatactagctaaatagctgagatagttttgcttccattcaggaaggagtaagggcaggtacctgtgccatgtgcacagggatctgactgtgwgaggagtawggggctraggctgagcacagagagacagcaccacgctcatgggcccagggattgcgagagcactgtgtagtgaccaaaggacgttcttgagcgtgttttggaatttggcactattggctggaaaatgctgatggttttaacctctcagtcttcttggt

SEQ ID NO: 32857 - DNA, 190 bp, Homo sapiens
  misc_feature 119: s=g or c
  misc_feature 129: m=a or c
gataaattgatatacccatgtaaccaacactccagtcaagcttcagaatatttccatcaccccagaaggttctcttgtatacctgctcagtcagttcctttcactcccgattgtttggscagccattgmtaggaattctatcactataggttagttttctttgttccagaacatcatgaaagcagcgtct

SEQ ID NO: 32858 - DNA, 73 bp, Homo sapiens
atccagaatcacaggtgagttttaccaaatggtaccgaaacagtgagcttagacacttacatctttttttttt

SEQ ID NO: 32859 - DNA, 125 bp, Homo sapiens
  misc_feature 78: s=g or c
  misc_feature 79: y=c or t
  misc_feature 110: m=a or c
  misc_feature 119: y=c or t
  misc_feature 122: v=a or c or g
  misc_feature 124: m=a or c
  misc_feature 125: h=a or c or t
agtgaggaggtggttcttgcccgtgttgtgtgtgtgtgtgagtgagagagcgagtgagtgagtgagtgagtgtgtgtsygggggggactcggcttgttgttgtcggtgamttccccctycgvcmh

SEQ ID NO: 32860 - DNA, 356 bp, Homo sapiens
  misc_feature 119: r=a or g
  misc_feature 121: w=a or t
ttaaaattatgcagctactatgggaaacagtatgaaaagtcctcaaaaaaatgaaagataaaaatactatatagtccagtgggaactactggggaggggaggtgggggcaaaggggttrawaaactatctattgggtgctatgttcactatctgggtggtgggaacattcctaccccaaacctcagcatcacacaatataaccacgcaacaaacctgcacattttaccccttgaatctaaaataaatgttgaaattatcaaataagaagaaataccatataatctggaaatcccacttctgagtatatatatttaaaaaactgaaatcaaaattttgaagagctgtctgcactgct

SEQ ID NO: 32861 - DNA, 382 bp, Homo sapiens
  misc_feature 114: m=a or c
ctcagagcttctgcattaaaaaaggctgtcaactgcctcttttcacttttaaagaatctcaacaaaaataagtaaccaacagcattttcaacatcaaactacttctctcttacmaaacccaaatgaacaactgtcaatagatgaggaatcctcaagtttggatgacacaatcctgcctcactgctgtattcagagtccatgttgtaggatgaggagtgtagaaaaccctgatgctgccatttactgagtacctatctcatggcaagtatttgaggtcctttacacagagatttcatctaatcctcaaagtaaactatgatatggtgtgatcagctcacacagttgaagatgctgaaggtcaaaaatgttagacaacagactc

SEQ ID NO: 32862 - DNA, 265 bp, Homo sapiens
  misc_feature 263: y=c or t
  misc_feature 264: n=a, g, c or t
  misc_feature 265: n=a, g, c or t
tgcaataaaagttaggagatgacattctgtttgcctctcatgttttataatcatttcttctaacatatattttttgctagactataagattaatagggatacagaaagtgtgataagtctagcaaactttaaaaaataaagatagaatattttgggtaattgtcacattattgctgctatgcatttgctatatttcttttcccataatgatgtcaggacactgattattcattttgcaaaaatgatatatagagaagccgacynn

SEQ ID NO: 32863 - DNA, 275 bp, Homo sapiens
  misc_feature 117: k=g or t
  misc_feature 211: r=a or g
ctgttcttgtaaatagtagatttgaaacttaaaagaaaaactttcaaaaaatgatcataaaaatatttaaatctactgttttcctttgttgtttattagatgagatcacagcctagkttttcgtcgctttggccctctgattgtggattggcctcataaagctgagagcaaatcctattttcctcctaaaggtaattctcaagattcattrtacttatgtaatttattcttacattgtttaatgtgtagccttttcataaatgttcaccttccct

SEQ ID NO: 32864 - DNA, 86 bp, Homo sapiens
  misc_feature 71: s=g or c
aagacgagggggcatggcctctgcgagtcactctgctacaatccagcttctaatccgcccaaaagcggcasccaatcggagcgcga

SEQ ID NO: 32865 - DNA, 315 bp, Homo sapiens
taagtgtccatcagcagacaaatggattaagaaaatatggtatatatacacaaagggatactatttggccataaaaaatattgcagtcatgtcatttgtagcaacatggatggaattggaggtcattatgttaagtgcaataaggcaggcatagaaagacaaatgtggcatgttctcacttatatgggagctaaaaaagtggccaggcgtggtggctcacacctataatcccagcactttgggaggccgaggcgcgcggatcacctgaggtcaggagttcgagaccggcctgaccaacatggagaaaccccatct

SEQ ID NO: 32866 - DNA, 159 bp, Homo sapiens
gaaattggttgttcgagatttcgttttctgtgcgtaagtggctgttcagatgcttacatgctgtcttaataccgaagatgccatccttttttccagggccctcttcttacatgggaaggatagtggatcctactttaaaatgcgattatagtggggcct

SEQ ID NO: 32867 - DNA, 112 bp, Homo sapiens
  misc_feature 11: k=g or t
  misc_feature 56: k=g or t
  misc_feature 82: w=a or t
cctttctcgtkccccggccatcttagcggctgctgttggttgggggccgtcccgckcctaaggcaggaagatggtggccgcwaagaagacgaaaaggtcgctggagtcgatc

SEQ ID NO: 32868 - DNA, 259 bp, Homo sapiens
tagaaaatgttgaatttttagtgattccagaaattgatctctatcgatgaaactgctttctcaaatacgtcagcaatgggattcaggctttgcttacaatgtgaaggaagttcttagtctcatttgcacaaagaaggaaggagggctaaagataaaaagaactcatagtcttttccatagttttgggtcatgttcactgtaaaaaaaaatcacaagatgccatttttacacagcctttttaatctacacatacggcgaa

SEQ ID NO: 32869 - DNA, 188 bp, Homo sapiens
  misc_feature 17: k=g or t
  misc_feature 99: m=a or c
  misc_feature 104: m=a or c
  misc_feature 106: w=a or t
  misc_feature 108: w=a or t
  misc_feature 112: d=a or g or t
  misc_feature 115: w=a or t
  misc_feature 123: r=a or g
  misc_feature 125: s=g or c
  misc_feature 126: n=a, g, c or t
  misc_feature 164: k=g or t
cacacacgcaagtcatkctgacatgtcgttaactatgcaggttgtgatcaacctgtacaattcgttcgttggaagaaaaaaaaatcgctatcgaacccmaaacmawtwtaadggwacttgctrasnaatctggactaatttgaaagattgcttttagaagttakcaggattaaagttgcatacagtgc

SEQ ID NO: 32870 - DNA, 198 bp, Homo sapiens
  misc_feature 91: w=a or t
  misc_feature 95: s=g or c
  misc_feature 106: w=a or t
  misc_feature 111: w=a or t
  misc_feature 112: r=a or g
  misc_feature 125: d=a or g or t
  misc_feature 143: r=a or g
  misc_feature 151: w=a or t
  misc_feature 180: w=a or t
  misc_feature 184: s=g or c
  misc_feature 185: n=a, g, c or t
  misc_feature 194: w=a or t
ctctaggtaaattgtgtttgtttagtcctcaggggtctttatgacctctgtagccatcatgggatggctcagagctttcccttgactggcwatastgggaagaggwcagcwrccccctgtgattdgttttctattcaaggaarcttttggwcccagtctcccatgttccaggtggtaggwgtcsngcagcccgwcatt

SEQ ID NO: 32871 - DNA, 341 bp, Homo sapiens
cttgaatatcttaaaggtatctcaaatccagtatgtctaaaatgaaactgatttccccttccctccctacaaaactgcacaacgttggttctttctttgttccttttttcagtgaatgacacaattatcttttcattgtaaaatccagaaaactagaagtgatccttaattccctctccctgatagatccaatgattgaacaagtttttaaagtcttactttctacatgactcttgaatttttctatttcttcctgtttccactactgccacttcatcttgcctgaaacttttacaatagcctccattcttatctgtcctctctaattcattacccatcta

SEQ ID NO: 32872 - DNA, 170 bp, Homo sapiens
  misc_feature 108: r=a or g
tttcattatataatgatacatttagacaaaaccccaaactaagccatttgaaacaagattctctccattgcagtttgtagcaatgttatttctgtgtatgtcatgagraggctaaatatcagtgttaatttcttgtttgaatccgtgaaatcatgcctgtaaagcccgtc

SEQ ID NO: 32873 - DNA, 100 bp, Homo sapiens
actctggacgggaggaagtgcgagcggatccaaagggtcgagcggagtggggtaccgccctgacgcccaagagcaaatggaagagggcggcctccggggt

SEQ ID NO: 32874 - DNA, 382 bp, Homo sapiens
  misc_feature 283: n=a, g, c or t
  misc_feature 284: n=a, g, c or t
  misc_feature 311: m=a or c
  misc_feature 319: k=g or t
  misc_feature 321: k=g or t
  misc_feature 352: s=g or c
caaacctgcagacacttgacacctctgtgtttccacttccccagggaagtaagtcatggaccctctgggcatgtggggtagggaggacaaggctggggccagacagtcctgtgccttcccttagcagccaggccaggagtggtggctcacgcctgtaatcccagcactttgggaggctgaggtgggcggatcacctgaggtcgggagctcgagaccagcctgaccaatatggagaaaccctgtctctactaaaaatacaaaattagctgggcgttgtggcacnngcctgtaatcccagctacccgggaggmggaggttktkgtgagcccagatcgcgccattacactctagscctaggcaacaggagggaaactctgtctca

SEQ ID NO: 32875 - DNA, 266 bp, Homo sapiens
  misc_feature 107: k=g or t
  misc_feature 108: s=g or c
  misc_feature 113: v=a or c or g
  misc_feature 126: m=a or c
  misc_feature 127: m=a or c
  misc_feature 177: d=a or g or t
  misc_feature 191: w=a or t
  misc_feature 212: r=a or g
  misc_feature 222: k=g or t
caaataattctagagttttggagtggggtgcttaggaacctcatgttttctgacattgtgacttactcccgttgagctgctcttcccgaagcactgaggcaggagtkstcttvcacccaatcaaammtggccctctcagttaacattccttagcagtgcaagtcaaagagacacttdaaagtgtctctgawttttaatacatcactctgcargtcagtgtckatctggaaatttctacgtgagaggtgatggaaccagagtttact

SEQ ID NO: 32876 - DNA, 261 bp, Homo sapiens
gatgtgatagtgctaggtgtagtcatgttaatatgaatatattttatatttcaggatttctagtttgtaatttctaggagcattatcaacatatcatctatagaatccacgataacagcaatttctaaataattttaacctttttcatttttcttctgcatccagaaagagctctgcaaatttgttttgctcaacgaggtgatgaaatttcccgtattgtcaattcagctcttcaccacctttaatgttttaatcccataa

SEQ ID NO: 32877 - DNA, 219 bp, Homo sapiens
  misc_feature 115: k=g or t
atgtccacgcttgcatgatgctaggtggcaatgccactttaaattaagccttaatcagatgttaaatttgtgagtttcagagtatgcaaaaatattaggcagagtgagtgtaackgttcagatcaagatgctgtatcataattcaagttatttttttctggagttaaagggaagcattcagtgatacacctctctctctctctctctctctctccccca

SEQ ID NO: 32878 - DNA, 307 bp, Homo sapiens
  misc_feature 266: m=a or c
  misc_feature 274: m=a or c
tattaagactaagcctcctggccgagcgcggtggctcacgcctgtaatcccggcactttgggaggccaaggcgggcggatcaagaggtcaggagatcgagaccatcctggcgaacacggtgaaaccccgtctctactaaacacacaaagaattagccaggcgtggtggcgggcgcctgtagtcccagctactcgggaggctgaggcgggagaattgcttgaacctgggaggcagaggttgcagtgagccgagatctcaccattgcmactccaamctggctgacagagtgagactgcgtctcaaaaat

SEQ ID NO: 32879 - DNA, 354 bp, Homo sapiens
  misc_feature 204: m=a or c
  misc_feature 292: m=a or c
taagtttaaaatgctgtttctcacaagatactgtttttagagttttctctcctgtttcacattggcctcccacgcccatttcagaagggtgttctataacacagtttggagaaggctaagggcagtgcaaatggaagatgctggccagctgccctgttcagtaagaggaaatgagcttaaagtgatgcaatgaggcattcagamgaaattttaggaagtttcctgacaatgaagattgttaacaattccatgtctcatagtcttttaagaaagagcatgtgtcctgaaaaamtctccctaaaatcaagacgataaataggttggctgacttcctttcaagattagtgattcacc

SEQ ID NO: 32880 - DNA, 128 bp, Homo sapiens
gactggagttgtataatgtatcacttatattttgaaatgttgtatgtaacacaataatttcttgccactgctcttctgtgttcttctccctaaagatctctgttactagtcaacaattaacctccacc

SEQ ID NO: 32881 - DNA, 329 bp, Homo sapiens
  misc_feature 323: n=a, g, c or t
  misc_feature 324: n=a, g, c or t
taataaaaactatttgtagactacaaaggcatttcttcctgcaatgacgaagaataaccatggccatattgtcactgtggcttcggcagctggacatgtctcggtccccttcttactggcttactggtatgtgaacatgtgtttccttcattggttcttatgcctaccttgtgtgtgagatttcttaccctgtctaataagaactctctttataatcataagagacttgaagttttccagtttattattgagagttgtcaaaaaataagcagaaagagttgcacaaagtctcttgtctaacagcattatcaatcattaatccnnttctg

SEQ ID NO: 32882 - DNA, 271 bp, Homo sapiens
  misc_feature 166: r=a or g
  misc_feature 167: k=g or t
catgaacaattagaagaaatggcaatgtagcttctgacatttgttcttagaaattatctgtttctttttttcttctcttttaatgagtctttatatgattttattttaaattcataaattgatttgcttgagtggtttagtctgagcagtattggaacttgattgrkttcccattttaagatccttttaaaaagtggtgattcaattccagtgaagcataactcaaattgtgtgtattgaagacttttgtaattacatttttgccccatat

SEQ ID NO: 32883 - DNA, 131 bp, Homo sapiens
tattcctgcaaacaagtagtacattgaaaacagtcataataacgcaaaccgcaaatgaaaccaaagaaagtggaagagatgtgcttctccaggtctcagtgcatactctctatcttccatattgtgaggaa

SEQ ID NO: 32884 - DNA, 151 bp, Homo sapiens
  misc_feature 127: y=c or t
ttaatttataagatctaatgtgaaatccacacttggaactttttaggatctgtctgttgcttgtttaatatatttcttttatgacattacttaaagtttaaaagggttttctatccactgtcaattycaattggataacattttgtcaagt

SEQ ID NO: 32885 - DNA, 303 bp, Homo sapiens
catatcttgcctttaggaaaggcctccaaatctctcttattaagcagtcatttgttaaaaactgtcttttcttgagcagacctatggtgtttgtctctttatgttcagttaacagcattcaacattccagtgaaatgtagatattgctttacttctactttataaatgaggagggaaaaaggtgctaaagagatcagcatcttgtctggaatcacacacccttatatagcagtgtccatagtagactttaagctgtttgacatgaaccgctactcatcattggtcttaataattacagaatca

SEQ ID NO: 32886 - DNA, 291 bp, Homo sapiens
  misc_feature 51: r=a or g
  misc_feature 117: m=a or c
  misc_feature 118: h=a or c or t
  misc_feature 130: v=a or c or g
  misc_feature 210: m=a or c
catactaaagaacacatctggaagcaaccagcaggcctttttactggagarcgtcccttgtaataatgcaagctgtgaagaggcgcgtcgaatgtttaaagtctactgggagctgamhgacctaaatcavattaaggatgccatggttgcccaccttctttgacatttacgaagatggaaatcttggacattgtagtgctaagtaaaggmtatacaaagaatgattttgccattcatacactaaaaaataactttgaagcagatgcttattttgttaaagttattgttctt

SEQ ID NO: 32887 - DNA, 286 bp, Homo sapiens
  misc_feature 167: n=a, g, c or t
  misc_feature 168: m=a or c
caagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgctttttttnmaactacggagtgtcactgctttctagctcagtccctgcagactcttctcaactctttccctataggaaacttactccgcgtcctgcccccacctcctaaataaataaaggaatcagcg

SEQ ID NO: 32888 - DNA, 149 bp, Homo sapiens
  misc_feature 133: r=a or g
gagccgtgaagatggcggcagtggtggaggtggaggttggaggtggtgctgctggggaacgggagctggatgaggttgatatgtcagatctctctccagaagagcaatggagggtcgagcacgcacgcatgcrtgccaagcaccgggcc

SEQ ID NO: 32889 - DNA, 144 bp, Homo sapiens
aactgagacaagttgtggaagtttcttaatctgacagtggtttcagtgtgtaccttatcttcattataacaacacaatatcaatccagcaatctttagactacaataatacttttatccatgtgctcaagaaaggggccccagc

SEQ ID NO: 32890 - DNA, 190 bp, Homo sapiens
ctttctttttaaatgtttatggtagaagaacatcaagtatagttgtcaacagacttcttaatattactggttgtgcctgtgcctccaaagcatggatttgatagctccaatattgtaatctaaatttcctgggtaccagttttaatcatatgaacttgctgaagttaacgaagcagctgtccagaagaat

SEQ ID NO: 32891 - DNA, 138 bp, Homo sapiens
tatttgccccagcatgtcctacaggaactgcccagtcggcccaaacagggtgccccttcttcttcagctttcctcagtcagtcaccggatcctaaacgtctctagaatgtgtccttcttgatccatgacccacacttt

SEQ ID NO: 32892 - DNA, 266 bp, Homo sapiens
  misc_feature 189: d=a or g or t
aaggaccgggactcgggggcttgttcagggtgagcagactcggctgcaagacctggaaaggtcacatctcctggggaagcccttacagaggccttggccaccacttctgcaggtcccgtctctccactgtgccatcccccccggggctgactgcctcccgctcttcctctggggacgaacacacagcgdtcagtcgaggagaggaagcacccagggcttccccgcctcctccctactcatagctgcagacatccccgcccgcacct

SEQ ID NO: 32893 - DNA, 378 bp, Homo sapiens
  misc_feature 373: r=a or g
  misc_feature 374: b=c or g or t
  misc_feature 375: r=a or g
gatgattttgaggatttaagatttagagctccttttagcagttcttttagtgctggcttggtagtggcaaattcagcatttgtttgtctgaagaagactgtatctttccttcatttatgaagcttaattttgttggatacaaaattcttggctgataattgctttgtttaaggaagctaaagataggaccccaatcccttttagcttgtagggtttcggctgagaaatctgctattaatctgataggttatcttttataggttacctgatgcttttgccgcatagctcttaagagtctttcctttttcttgactttagataacctgatgactatgtgcctaggcaatgatctttttgtgatgaatttcccagrbrgtg

SEQ ID NO: 32894 - DNA, 318 bp, Homo sapiens
  misc_feature 217: y=c or t
  misc_feature 256: b=c or g or t
ctcaataaattttaaaaggtcaaaattatacaaagggccaggtgtggtggctcacagctgtaatcccagcactttgtggggctgagacaggcggatcacttgagcccaggagttcaagaccagcctgggcaacatggtgaaaccctgtctctaccaaaataaaaaataaaaaaattagccggctgtagtggtggtgaacgcctgtggccccagctaytcaggaggctcaggcaggaggatggcttgagcctggaabgcagaggctgcagtgacctgagatcataccactacactccagcctgcaggacagagcgggac

SEQ ID NO: 32895 - DNA, 289 bp, Homo sapiens
acgacttttttccaaggacccacttggcgtcatttgctaaatgctcctcttaacggtggtgagtcttatctcctcttacattgacagtactgacaagtatacatatatatatttttaaattttactttaagttctgggatacatgtgtagaacgtgcaggtttgttacataggtatacatgtgccatggtggtttgctgcacccatcaacccgtcatctaggttttaagccccacatgcattaggtatttgtcctaatgctgtccctgccctttctccccacccctccc

SEQ ID NO: 32896 - DNA, 353 bp, Homo sapiens
  misc_feature 15: w=a or t
  misc_feature 325: r=a or g
  misc_feature 330: w=a or t
acagggaattgtgtwattttaaatgattctggcagaccttgctttgtttcagtaaatctaatttcctaacagtaacatggctctggaggaaggatgaggtgaaggaaagagtggtatttacttacagaagaaaacattttcttacaagttggggatccatctaagggaatcacatatgtgatgtgctggcatgcatagactggaaagatcgcagcctgtagagggcttaaattacttattttttccattctaactcggtagttttactacgatcatcagttgggtctctctgacttacaaatttgtaaaaattatacctgaaagratttwacttaggacatctaaaaacaaca

SEQ ID NO: 32897 - DNA, 147 bp, Homo sapiens
cagaaaatgaaggatttctcaagttatattattatcaagatatattatatcccccacgaaagtggtacatttgttaaaattgatggacctacattcagacatctttaccacccaaagtccatggtttacattagggttttttttttt

SEQ ID NO: 32898 - DNA, 318 bp, Homo sapiens
  misc_feature 102: h=a or c or t
  misc_feature 230: r=a or g
  misc_feature 231: k=g or t
tttgattaaaggtaatgattaacatccctttttgttcatacttccttctgaggctgttttcccctaaacagtatcttaatctgttacatgtaattgaaatahtatttgaagcagtgagttattgtaacctcagattagttacattgatcaaaacattgatttatacacacacacacacacatacatatgtagcttttatatttagtctggttacattagtgaccatggtrkttactttcttcttaaggagcctttgaatttcttgtccagataaaaaatccgaatatttctcttagactcatacataaagggacaagc

SEQ ID NO: 32899 - DNA, 403 bp, Homo sapiens
  misc_feature 145: r=a or g
  misc_feature 146: r=a or g
  misc_feature 372: y=c or t
  misc_feature 373: y=c or t
tgcagtccttcaggaagtaaatctgaagaaaagtttttagttgtattgtttttttctttttatgtggttctaaattggaaaatgaaaatattataaaattattaatacttgttagaataatatttgtattcatttaggcaaggarrttaacctttctgaacttgagttactttttctgaaggcctggtttttcactatgttgtgatgaaaagcagatgaggtagtctgttaacatagttaattctgtcttgggactgggatatagttgagaggcctattattttgggacactgggagatataagtactatataagtacaaagaagggcacaggaaaaaaggtgcagttgttttgataggccaggttcagcayyaagaccatcagacattaaggagaaacagga

SEQ ID NO: 32900 - DNA, 153 bp, Homo sapiens
  misc_feature 89: y=c or t
  misc_feature 105: k=g or t
  misc_feature 106: y=c or t
  misc_feature 119: k=g or t
  misc_feature 124: w=a or t
  misc_feature 125: w=a or t
cagttaagtgtatctgtgtgtgagcaagtttatatgtgtacacatgtttgcccatgtgtacttgtctttgtgtgtgtctgtatatgtayaatatgcaatttttakyttttgtgtttgtktgcgwwttgctaaagtgtatgagtgtgcctttgt

SEQ ID NO: 32901 - DNA, 53 bp, Homo sapiens
  misc_feature 5: k=g or t
  misc_feature 26: y=c or t
  misc_feature 28: k=g or t
  misc_feature 29: y=c or t
  misc_feature 42: k=g or t
accakgacgagccaggctccagggaygkyaggcgtttcacckcctccagcctc

SEQ ID NO: 32902 - DNA, 76 bp, Homo sapiens
  misc_feature 3: m=a or c
  misc_feature 30: k=g or t
ggmaagcagaattatgatgacttttttcgkattgtcaaataaataataccacctacattgatgatgaaacaaatat

SEQ ID NO: 32903 - DNA, 369 bp, Homo sapiens
  misc_feature 137: h=a or c or t
  misc_feature 138: n=a, g, c or t
  misc_feature 237: s=g or c
  misc_feature 349: w=a or t
  misc_feature 353: v=a or c or g
ttttagagtacgaacattctaatgcatgactcaaaatgtccagtgttgtggttactagttattttatatatgcatttgttaataatgaagcaatagagactaagaccaatagcttgaatatattcagattattttchngttttaataaaggatttttcttacttccattgaaaatgggaagtagaagataaacaggggcaaccacaagacattcaaactgtcaggactagggcgtasagtgcccaccctctaaccacttgcctggttccgttagtccccaagcatgtttgaaaacaaaagacacaaactaagcatgctgaataaaactagctgctatggctgtaataawcagvaaggtgcagagtttca

SEQ ID NO: 32904 - DNA, 181 bp, Homo sapiens
tcaggtatgggggcaccttccagaacgtgtctgtgcagctgcccatcactctcaacaaattcttccagccgacagaaatggcttctcaggatttctttcaacgttggaagtagttgagcaatccacagcaggaagtgcagaacatcttcaaagcaaagcacccaatggacacacaagtcac

SEQ ID NO: 32905 - DNA, 414 bp, Homo sapiens
  misc_feature 233: n=a, g, c or t
  misc_feature 234: r=a or g
  misc_feature 235: s=g or c
atgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagttnrstttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaa

SEQ ID NO: 32906 - DNA, 424 bp, Homo sapiens
  misc_feature 341: k=g or t
gatacagatgcgaaaaattccttcttccaccgcccttctcgttctgtaaagaaagaaaagaaacatagcctttctgcatatattctaaacgtctctctgcctctgtctgacatggggccaccccacaggtcagagtggtggtagaaccccttcaggactcccagccgtggtcaggctctgaatactcccttcccaacatccagactgctgggcctttggcatccacttacattagaacccacgtttgtttcagagcacattttggactttcactgttgggaaatgaatgaatttataacatgcctgcacagcgaaggaacacacctgtcgctcttagctckagagtcagaggatgagtaaacccagatgcaagagtataggacattgagtggggagaacaagacgaccacagaagtcctcagaa

SEQ ID NO: 32907 - DNA, 419 bp, Homo sapiens
ttgaacccgggagacaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaa

SEQ ID NO: 32908 - DNA, 298 bp, Homo sapiens
  misc_feature 224: r=a or g
ctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccrgaaatggctttgaattttaagcaattactagttttaattagctctgccctcatgaagtattattataattcacc

SEQ ID NO: 32909 - DNA, 406 bp, Homo sapiens
  misc_feature 132: n=a, g, c or t
  misc_feature 300: h=a or c or t
  misc_feature 397: m=a or c
tgtttggggatggcctgaactgcatccatataacacttaattgaggccaggtgtggtggttcgcgcctgtaatcccagcactttgggaggctgaggtgggcagatcgtgaggtcaggaattcgagatcagcntggccaacatggtgaaaccccgtctctgctaaaagtacaaaaaaattagctgggtgtggtgacgcacacctgtagtcccagctacttgggaggctgaggcaggagagtcgcttgaactggggaggcggaggttgcagtgagccaagatcatgccactgcactctagchtcagtgatagagcaagactccatctcaaataataataataataaagacttaattgatacttaatccataaatgttgtatgtgttctgagtgctccamccacctaca

SEQ ID NO: 32910 - DNA, 75 bp, Homo sapiens
  misc_feature 19: w=a or t
ctgtaaaccacctagtacwtcccaaacatgccatttcattagttgaatctttagggttttttttttttttttttt

SEQ ID NO: 32911 - DNA, 355 bp, Homo sapiens
  misc_feature 15: s=g or c
  misc_feature 16: k=g or t
  misc_feature 70: s=g or c
  misc_feature 325: r=a or g
  misc_feature 326: n=a, g, c or t
  misc_feature 333: w=a or t
cacaattttacctgskcaagaatggaaacctcctcttccagcttatgattttctaagtatgatagatgcsgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaattttatagggctgtggtttccaaaatttttttggcatgrntagactwaatttatttccttaaagaataa

SEQ ID NO: 32912 - DNA, 334 bp, Homo sapiens
  misc_feature 96: k=g or t
  misc_feature 124: n=a, g, c or t
  misc_feature 131: b=c or g or t
  misc_feature 132: n=a, g, c or t
  misc_feature 224: s=g or c
  misc_feature 225: n=a, g, c or t
  misc_feature 270: s=g or c
  misc_feature 271: n=a, g, c or t
  misc_feature 286: k=g or t
  misc_feature 309: r=a or g
  misc_feature 310: k=g or t
catttgattaaatttattactgtgtatcccatcattaaggtaactaattttcagtaattaaactgttggtcttctgtttagccattattctcagtkctgtgcaggagtgagctgaaacaaagtngtatagbncagagagtgagaagctgcatttcatgtctcccaacagtcagaaagggattatgtactgtttaaggaaggagattggcgaatattttgaaacsnttttgggaaagcatagaatattgaaaatccaaaattaaccaaatsngtgagtgtgcaagckcaaagctagagaccttaggaatrkcttaggatgtgcaaaacaggaagg

SEQ ID NO: 32913 - DNA, 375 bp, Homo sapiens
  misc_feature 215: r=a or g
ataacgctacctgccgagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagtctcatttccagttcctccatgacgtggcaagtgaagacaggaatgaaaggratgtaaagcagcttttctctgaagagaagaagagagagagacacagccaagaccgaggctgggccaagatggtgtctgtgtttcgaagcgaggagatgtgtttgtcacaactgtttctccaggtggaagctgcatattgctgtgtggctgagctcggaga

SEQ ID NO: 32914 - DNA, 345 bp, Homo sapiens
  misc_feature 173: n=a, g, c or t
  misc_feature 317: w=a or t
cattattaaaagaaaaaaaaaattcacatgttgatgtgaaggcaactgggtgtcatttccctttaaatagtacaaaacatatgggggcaggattgcatttgtcacaaattgtcaaaatatttttttaaagaaaccaaaatcttctagggatggttccaaatgtgcctgatttncctgagcagtgagcagtgcgacctttacattagcagatatatttataaatacacatatggcccgccaggacctgattggctgctgatctgatgagacagcgacagatttaatggtgtttcacctacctggggtttagttttttwagttactgatttaccttagcagttttca

SEQ ID NO: 32915 - DNA, 419 bp, Homo sapiens
  misc_feature 419: y=c or t
tctgcctcccaggctcaagtgattcttctgcctcaacctcctgaatagctgggattacaggcacatgccaccacgcctggctactttttgtattttttagtagaggtagagtttcaccatgttggccaggctggtcttgaactcctgacctcaagtaatctgcctgcctcagcctcccaaagtgctgggattacaagcatgagccaccgtgcccagcctaaaattcagattttaattggcacgttaaagatgccagttagtttgtgtgtgtaaatttgaagagtaaattggaaaactgaatgaagtttgacttgtctgcttgcatatatggagaaaatgaaaaacgtactctaaaattttaacctagatttttgaaactctgaaagaacaaggaaccaaatcttactacagaactgaay

SEQ ID NO: 32916 - DNA, 429 bp, Homo sapiens
  misc_feature 395: n=a, g, c or t
  misc_feature 396: n=a, g, c or t
  misc_feature 397: n=a, g, c or t
ctgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaaggaaannngggtttgggtagaggtagaaaggtttaattaa

SEQ ID NO: 32917 - DNA, 230 bp, Homo sapiens
  misc_feature 91: r=a or g
  misc_feature 92: v=a or c or g
gtgttttccatattttactgttttcttgccatttccatatgaatttaagttccttacgttagtggtttctccttatgtgactttctcccgrvgtgcgagtcctcactgcaggatgcgataccggctgaatgcttccaaagcaccttttgcagtgtgaatgcccgggtgtgtaggaagtgcgagttccccgagcaaactctctcacccgcgctgtgttcctaggcccccca

SEQ ID NO: 32918 - DNA, 377 bp, Homo sapiens
  misc_feature 256: v=a or c or g
  misc_feature 372: b=c or g or t
  misc_feature 373: n=a, g, c or t
aatcaatagcaaacccactgccatattagttattctgaatatactaaaaaaatccagctagattgcagtttaataattaaactgtacatactgtgcatataatgaattttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatvgtctttgttgtacattgtcagtgtaataaaaacagaatctttgtatatcaaaatcatgtagtttgtataaaatgtgggaaggatttatttacagtgtgttgtaattttgtaaaggbnaatg

SEQ ID NO: 32919 - DNA, 240 bp, Homo sapiens
  misc_feature 100: r=a or g
  misc_feature 170: m=a or c
atgttctggggatccaggtagattatttttaaaatatttaaagtcactaatgaggttcactcactcactcattcattcaaattataagaagctgctactrttaccttaatgtaatgggtactgtacaatacactggaagtgaaatagataaatagaacaatatgaaagamagtaaacagaagtcaaagtacgtatctgtgatcagtagtgagttaatggttgtaaatagtttggggtccc

SEQ ID NO: 32920 - DNA, 287 bp, Homo sapiens
taaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgtctaaatgaactttacatatattttaaatgaatgtatgtacttacgtataaatgtctttatatagcttgaataaaaacactgcg

SEQ ID NO: 32921 - DNA, 280 bp, Homo sapiens
catcactcccttcaaagcctttcttcctttatatcttctgactgagctctccctgattgacatcacctcatgcgatgacctccctcattctgtgctgcctcagcacttatcttttgaagtttgtactgtgggtccatgtacttactaatatgttgctttgtaattattttctagcactctgtgttacagtttcatatttgtatttatttccaaaattaaattgtaagctccttgagggcaggaataataacttttacatttgtatctctgcacccccata

SEQ ID NO: 32922 - DNA, 181 bp, Homo sapiens
  misc_feature 3: y=c or t
  misc_feature 29: b=c or g or t
  misc_feature 30: d=a or g or t
  misc_feature 31: y=c or t
  misc_feature 36: w=a or t
  misc_feature 40: h=a or c or t
  misc_feature 52: w=a or t
  misc_feature 56: y=c or t
  misc_feature 93: y=c or t
  misc_feature 106: h=a or c or t
  misc_feature 113: y=c or t
  misc_feature 137: w=a or t
  misc_feature 138: w=a or t
aaycagggcaacgccgcgggagagaaccbdyacctwggchgcactaagttcwcggygccactccctggcagggcgggaccttgtttaggcccygtgatcgcgcgghtcgtagyagcgcaaaggcgcagagtggaccwwgacccgcctagagcgggaagagtttggcccgccgggtcccaaa

SEQ ID NO: 32923 - DNA, 402 bp, Homo sapiens
cctcctcagcctcctcagtaccattctgttaccaccattggtcctgcattctgagtttgccacctggcacgtgcccttcaaatgtctccactgcgtctttgcctttcccttttctgttgcgtgccatcattccgattccgattttaacagcaacctgctgatttcctgccatagtttcctactttccattctgagcccctttaatccacttatacaatataactactccctgaattatttggtcataccacttgtatctgccgaacccctattcctcccctggggtacgttttccactaaacacacacagggaaatgccacccaaatagctctatgtgtgccttgttcattcttgtttccatttctttgttttatgcactttttatctctccatccatacaa

SEQ ID NO: 32924 - DNA, 361 bp, Homo sapiens
  misc_feature 318: s=g or c
  misc_feature 319: r=a or g
accaaaaaacaaacaggatgacacagagcgagactaggtatttgccacaggatcctgcaagtcccgacaatgcaatagatctggtagtgttcaaaggaaaatccataatggtcataaggaagtcataaagaaagcaagatgtcttgctttattaagaaaacttaaaacagcacttggaatataattaagttttttttttggttgggcatagtgccttgtgcctgtaatcccagcactttggaagttaaggtgggcagattgcccaagcgcaggagttcgagaccagcctggacaacattggagaagccccatctcaasraaaaaatacaaaaattagccgggtgtggtggcatgtgcttgt

SEQ ID NO: 32925 - DNA, 174 bp, Homo sapiens
  misc_feature 77: n=a, g, c or t
  misc_feature 95: k=g or t
  misc_feature 114: k=g or t
  misc_feature 119: k=g or t
  misc_feature 122: k=g or t
  misc_feature 130: k=g or t
  misc_feature 133: k=g or t
  misc_feature 138: k=g or t
  misc_feature 164: y=c or t
  misc_feature 173: k=g or t
agattatttttaataactatcagattttttaaaaccaggaaaattctagagaaactgagattttgtgagtcataatnctacagttctcttaaatkctcagtctttcagatatckatacktckccaatgtktckctatkataaaaacaacagtaattgaatgtcygtcccacckt

SEQ ID NO: 32926 - DNA, 226 bp, Homo sapiens
  misc_feature 15: s=g or c
  misc_feature 16: r=a or g
  misc_feature 109: w=a or t
  misc_feature 116: r=a or g
  misc_feature 187: r=a or g
  misc_feature 188: k=g or t
  misc_feature 215: k=g or t
ttactttaagattasraattcagaaactcttgtccggtgttcacgtcttttggtgggtgtccttggctgctactgttacatgggtgtaatagctgaagaggaagcatawaaagtcrgaattattccagaaagccaaggtaggagaatttatactaataaagtttcggataaatttgaatgaaatgtrktcctgtgaaaattattacatttgtttkgaagacattaa

SEQ ID NO: 32927 - DNA, 333 bp, Homo sapiens
  misc_feature 56: d=a or g or t
  misc_feature 57: d=a or g or t
  misc_feature 169: r=a or g
  misc_feature 265: n=a, g, c or t
caaaaaaacacaaaaaaacaaaaacaaaaaaccatacacacacacacacacacacddaatcagcatcataagggaatgtagccttccaacagagatgatgctgttcgtatgttaatctcagagacagtatttcaagagagtggcaggtctgttcctggtaaaattttarccattaggattgcagataaatgtttgaattctgctcctctctcatcaatccaggacagtatttgaagtgtgagggctttgtgtatagttgtttatncattaccacatttttgtattttaatagtctacaggctatataaaagaacatggctttttgactgataa

SEQ ID NO: 32928 - DNA, 179 bp, Homo sapiens
aatttcgcggcctagtggggcgtacgggcctcttttgaaagcctgagttacgatgtattgagcgcgtcgtatgcggccagcactaaggtccttctggcactcctctggtggaccgcccccatcggccacacttgccctgctctccagtgattctgtagctactggctccgtagtctcgc

SEQ ID NO: 32929 - DNA, 277 bp, Homo sapiens
atcattgagaagtgaaatttaatgccccttaataacaacatacatttgtctgagcttggagactggagaagccttgattgagttagaagtatgaagacattctcacataagattttattagtcttccattatttacaagcagatgttcaagcttcttgattgggttttatggggtttgtaatatgatcctctctacctctctaaattccaagttcagtattccctgctagcatctattcacaagataggctgcttttttcacggtcttccctcccta

SEQ ID NO: 32930 - DNA, 146 bp, Homo sapiens
  misc_feature 116: k=g or t
  misc_feature 123: n=a, g, c or t
  misc_feature 124: n=a, g, c or t
  misc_feature 125: s=g or c
acctaatattaaaaatcttcttctctaaaagtggcatataaccctgatcaagaggtcatgggctcagtttgatatatggttcacctcattcttactgaagtcctcattatgatcakcgaggcnnsgaatgtgtggtgtggggattc

SEQ ID NO: 32931 - DNA, 393 bp, Homo sapiens
cacaatattagctgcctgcttctgatgggtaggaggtaatcaaaatactcccaccaaagcactctatggtctagacttgatacttaaaatttagttttcagcattcctcaacaaggataccttgaggtaataggagatattttggtaagtgaaaataattcctgcttggaacacagcctactgaactcaggatttaatttcttgagtattaggcagttctcaataaattgatgtatactgaggaatgattctaaagaggttagtgatatcctgtttgagaatagatttagaaaactgaaggtactctccagctctacaattctgtattaggaacaatagggaaatgagaaagtgcctctatattgcaatctaatgagtctctgggggaagact

SEQ ID NO: 32932 - DNA, 394 bp, Homo sapiens
  misc_feature 16: d=a or g or t
tttagagcatgaaagdgtaatattaataaatatattgaattaacttcttcttcgtttgttttagtggtcccaatcgaggccattatattgcaatagttaagagtcatgatttttggttgttgtttgatgacgacattgtagaagtaagtagtttcttaatttcttatttttgaaagttgtatgcatatgttgcttttcacttttttctcatagtttttcatttatatatgacaggtgatgatatgagacaaatgtctgggtctatagattgtagtctaattcctacttcttactctgcaacgtccaagcccagcagttgagtggtcacctaacctttacacacctagaataaaacaagggaggccaggtgcggtggctcacgcctgtaatccca

SEQ ID NO: 32933 - DNA, 58 bp, Homo sapiens
  misc_feature 17: b=c or g or t
  misc_feature 28: r=a or g
  misc_feature 39: r=a or g
agcgagtccttgcctcbcggcggctcargacgagggcaratctcgttctggggcaagc

SEQ ID NO: 32934 - DNA, 365 bp, Homo sapiens
  misc_feature 15: r=a or g
  misc_feature 112: d=a or g or t
  misc_feature 116: y=c or t
  misc_feature 119: k=g or t
  misc_feature 121: r=a or g
  misc_feature 122: m=a or c
  misc_feature 147: y=c or t
  misc_feature 268: k=g or t
  misc_feature 272: h=a or c or t
  misc_feature 273: v=a or c or g
  misc_feature 308: n=a, g, c or t
  misc_feature 347: y=c or t
  misc_feature 348: w=a or t
tgaaataaattaagrtgtagaaagattttaccattttccatctctgtttctacctgtgtaactacaattgagtccctgagctaccctcagttgtttgtagtactaactaacdgttycakgrmcctgctagcaagtcagtttccatgytccatattgtgctaagtgatgtcagaaaggcatggaaggaagagctctaaaatgaagaaaaaaataaattttgataatgtgggcaccttgacagaatggattcagactattttttagcackgtchvtttattaaaataccaccgtcattcccttatcttcnaccactagtgagtggaaacatggataccagccgtcactywtgaaggcttgtcagaca

SEQ ID NO: 32935 - DNA, 416 bp, Homo sapiens
  misc_feature 388: w=a or t
aatccagggttgaaatggttcggttaagaagtatatgtattttttattttattacataatgccaggttattttccagtaggtgtatagcatttcctactcccaccaacagtactcagggtgcttgtttctctttacccttgccttcactggtatcatcagtctttctcatttttgccaatctgatgggtgaaaaacaatatccataattttcatgactatttgtcctttttttccatgtgtactggctttttcatttcttttatttgttacttatggatatcttttgctcatttgagaaaaataggagttgtcttaccactctctgcaagttctgtgcatggatattaactccttcacctgcgtagtgggttgtattttgtttcactwgtctcttgactttttttttttttttttt

SEQ ID NO: 32936 - DNA, 99 bp, Homo sapiens
ccttggcttagtgtggtgccttgtgcctataattttagccctttgggaggctgaggcaggaggattgattgaggtcaggacttcgagaccagcctgaac

SEQ ID NO: 32937 - DNA, 212 bp, Homo sapiens
  misc_feature 104: w=a or t
  misc_feature 119: w=a or t
cattttcacgttaagttcctatttttgtatgttctactcttaagttatataacacagttccttttttaaaagagttcatttgttgaagtgctagtgaaaaattwatggttaataaaatwggtttgcaaatgactatttataccagtatgcatataatttttaaatatttgtaatgtgagatgttgaatgaataaaacttttaactcagaaaa

SEQ ID NO: 32938 - DNA, 94 bp, Homo sapiens
tagaggtgaaggtttaggaccctaaacccagtatcgccggtcagagaaagtttcataggagagatggcttctgaagacatggaggaattaatca

SEQ ID NO: 32939 - DNA, 73 bp, Homo sapiens
aaaaggggagatgagtttgtctgtcctctgctgaggctacggccgggcctagggaactgggagcttgggtgga

SEQ ID NO: 32940 - DNA, 436 bp, Homo sapiens
  misc_feature 119: w=a or t
  misc_feature 168: d=a or g or t
  misc_feature 169: h=a or c or t
  misc_feature 170: n=a, g, c or t
  misc_feature 318: d=a or g or t
  misc_feature 408: r=a or g
tgtgctgtgtggttaggagaaggagggatgggagagagaaggggaaggaatgaggcatggagagagatcacaaccatcgtctcaatgaagcagcagcacacacagggatgtgtggtcgwcccaagttcaggggagagagtttaaaggcgggatgatcatatgtgaagdhntggcagcaccaatatggcactgtcaaagtaaaagagaaatagatctgaactggattttaatgagaataatagcaaatattaacatttcttagatagtttgatatttattctggaagtatcgctaccaacatcaacatctgggaaagcdagtgggcatcaaaatcctacctggctaatggaaagcaaagttttaatcagtgcatcactcctacgggcctctcaattaaaaataaaatgraacaaaatgacaaacttcttaattttgt

SEQ ID NO: 32941 - DNA, 74 bp, Homo sapiens
actcctagcggacacctcgtggagtccggccggaagagcaaccgagatgaaggtgaagatgctgagccggaatc

SEQ ID NO: 32942 - DNA, 191 bp, Homo sapiens
tagcctttatctgtttgtttattgccccatttttcatccttaaatattcctttatgtactttgtatttcacctggttccagattgggaagaaagaaaaagaggaaagaagcaagattctacatcataccactaccatattccttcgctttctagtatgttgatgtatttatgtgttatcagaattccgggc

SEQ ID NO: 32943 - DNA, 248 bp, Homo sapiens
  misc_feature 109: r=a or g
  misc_feature 111: r=a or g
  misc_feature 120: w=a or t
  misc_feature 123: k=g or t
ctccaatgatatttttataaagacaacgcattttttgtaaagtttgctgtgttcttttttgtagcttttttacatttatgttttaatagagtgggctttattaagtcargrataccttcwatkgtagattaagtacagagtaccaagaagggctaagttattcactgggtaacacaggattcctaaaattactgggaagttgtaatactgttattgaaataattcacactgtaaaatgttctcagata

SEQ ID NO: 32944 - DNA, 211 bp, Homo sapiens
  misc_feature 2: r=a or g
  misc_feature 17: n=a, g, c or t
  misc_feature 115: b=c or g or t
  misc_feature 116: r=a or g
  misc_feature 118: r=a or g
  misc_feature 182: w=a or t
araaagagtaggaggangaagcagaggagcaggagataaaggataaaatgagaggaggaggagaaatagaggagaagcagaggagcaggagataaaggataaaatgagaggaagbrgragaaatagaggagaaccagtggagaaggaggaggatgacaggaggaggaagaggcaatggagawgaggagaggaggagaagaggggaaggggc

SEQ ID NO: 32945 - DNA, 305 bp, Homo sapiens
  misc_feature 114: s=g or c
  misc_feature 242: s=g or c
  misc_feature 243: s=g or c
acttttggtgctggagaactcagaaggtggctcagccctctggtccacacttggtgggcagctcggatgccccaggcagcccgggcacagtgagcttagtccccttcaaccccstccgcagagctctggggcatccgcacagtcactcctggacacaagataaggaggagtttccccgaggcatcacagggcttcccgggactgagggactgactcaactggttattggacagtgccccacssccaatccggctgaggggcaggaaggcagaaggtcttggtggccctggatcttgtggctgcaa

SEQ ID NO: 32946 - DNA, 441 bp, Homo sapiens
ctgattcaactgtaattctggagccatgagttattttgcttgtgctcttgctttatttgtgtagttagctggttatttgttcaagcattatttgacattttcttagtaaaggagaccggtgagtagcttccagaagcccagaagcagacataacctccattgggacctcctgtgcacttatgccccgtaatcccctattccagattgttatgacccaaactttaaggagaactgaatgaaaaaggacagaaaggttaaatgtatcctactcaacatatttatgatgtttatttatttatttattaatttatttatttgagtcagagtctccctctgttgcccaggctggagtgcagtggggcaatctcggctcactgcagcctccacctcccaggttcaagcgattctcctgcctcagcctcccgagtagctgggattaca

SEQ ID NO: 32947 - DNA, 423 bp, Homo sapiens
  misc_feature 177: s=g or c
  misc_feature 302: n=a, g, c or t
  misc_feature 303: b=c or g or t
  misc_feature 304: v=a or c or g
aatgttttactgcattatgttcatcccatttttaaaacacaaaacaattttaggtgtctgtaaccctcgagacctttcaagatctgtccttgccaattcctggcaaggaagaccttgctaagctgcattcatcaagtcatccaacttctatagtcaaagcaggatcatgtggcgaasatatgctccacaagggtggatagcttttttcatggaatatgtgaagaggtatgtatttattttctttgtattacatgattgttaaacctgctgtttctgctgtactggcagaacacttcctttcnbvttctatcaatgatgtttcaggtttgttgtctcatgtgtccctagctggttttggggtccagtagtaaccttgcaagattgtcttgctgccttctttgccagagatgaactaaaaggtaa

SEQ ID NO: 32948 - DNA, 102 bp, Homo sapiens
cgctgctctctgtttttagtttgtgttttgtgtgtgttttatgtcatggaggggaaggtatacatccataaaaatcacttagaactggatccagaggaggat

SEQ ID NO: 32949 - DNA, 307 bp, Homo sapiens
tgaaaaagataatataccatgatcaagtgggtttatcccaggaatgcaaagatggctcaacatacacaaatcaatacatgtgatacatcacatcaacaagatgaaagtcaaaaactatctgatcatctcagcagatgcagaaagaaaaatcactcggtaaaacttaccatgccttcatgatgaaaactctcaacaaattatgcatagaaggaacacttcaacataagaaaaggcatatatgacaaatctacagctaacttcctactcactgggaaaaattgaaaagcctttcctctaataactggag

SEQ ID NO: 32950 - DNA, 208 bp, Homo sapiens
  misc_feature 201: k=g or t
cataaatagttcttattattttgagatgtgttccctcaatacctagtttattgagagtttttagcatgaagagctgttgaattttatcaaaggccttttccacatctattgagataattgtgtggtttttgtcactggttctgtttatgtgatagattacgtttattgatttatgtatgttgaaccattcttgcatcccakaggtgaa

SEQ ID NO: 32951 - DNA, 289 bp, Homo sapiens
  misc_feature 64: s=g or c
  misc_feature 70: v=a or c or g
  misc_feature 71: n=a, g, c or t
  misc_feature 72: n=a, g, c or t
  misc_feature 80: s=g or c
  misc_feature 94: s=g or c
  misc_feature 111: k=g or t
  misc_feature 117: b=c or g or t
  misc_feature 132: s=g or c
  misc_feature 177: k=g or t
  misc_feature 189: r=a or g
  misc_feature 206: s=g or c
  misc_feature 282: b=c or g or t
cccctttgctctctcggccgtttcccctacacccgcaggccttccacagctttttgaactgagsccaggvnntcgcaggsgatctcgaaggagsagcaactgcacggtgckcctcabatccgcgtgcccgasgtcaccggggaacaaagaagttacttatttttccttttagctcakatgaagagagarggcgttgtcttccacasaaagacgctgcgaactccgcccccgtccccctttttcttgcagcccttccgtgcgggtgcagctgtttaaactaabgccccaa

SEQ ID NO: 32952 - DNA, 289 bp, Homo sapiens
  misc_feature 164: n=a, g, c or t
  misc_feature 165: v=a or c or g
ggagatggccgggtgtggtggctcatgcctgtgatcccaaagtgctggggttacaggtgtgagccaatgagcccggtcccaatgtgacttattaaggatcacaccaaagttactacctggcatttttctggtggaagcactcagcgtacattctgatgacttgnvccaatataataattcgtctctactagaagacaagcagcagctgtcagctgccatgcataccagcagctggcaaacaaactaaatcctttttatgtgaaagaaaacaacatcctaatccaccacc

SEQ ID NO: 32953 - DNA, 130 bp, Homo sapiens
caacatttatgttttgagatattatgtgttaggcaccaagctaggtgctaggtaggggtgcaagggcgaaaaaggcaagttagctgctttgaagagcttacattctagtgggacccaataccagggcagt

SEQ ID NO: 32954 - DNA, 250 bp, Homo sapiens
  misc_feature 71: v=a or c or g
tatctccattttaagatgaggaaattgagacagacgagattacctaactctctcaaggtttcaccacagavcgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcgaggccg

SEQ ID NO: 32955 - DNA, 438 bp, Homo sapiens
  misc_feature 380: m=a or c
aactcgggacgtggctacatctcccatttcacctactgaaaataacaccactccaccagatgctttgacccggaatactgagaagcagaagaagaagcctaaaatgtctgatgaggagatcttggagaaattacgtaaggaatttgtagctttctgaacctttcttcgttttatgactggtcaagcacagagatttgctggtcgtaggcttggtccatgcagctggctggccatgcttggtaccttaggcacagactgcttctcctcaccctgcccctgaacctcccttccctgtctcacagccctggttggatactatgttaggatggagatgtggtgagagtgtggatagcttactttgagggcagggcatccctcamccctaggcatgtattatagcgaagacaaatagtttttctctaatgaatagcctagaat

SEQ ID NO: 32956 - DNA, 142 bp, Homo sapiens
ttttcttcctttagggtcctaatgtttttctcatcagctcatctaataaactccttttatatttagaatgataaaacccttatctttgtggcaaatatctttggcatttgccttttatgatttaattttatgatacacaaac

SEQ ID NO: 32957 - DNA, 397 bp, Homo sapiens
  misc_feature 96: r=a or g
  misc_feature 133: m=a or c
  misc_feature 134: s=g or c
  misc_feature 276: h=a or c or t
  misc_feature 318: m=a or c
  misc_feature 362: s=g or c
aaaatacaaaactcttttcgaagaagcaaacaaaaagtatgatggattacagcaacagttgtcttcagtagaaagggaattagaaaataaaagaaractgcaaaaacaggctgcaagtagtcaaagtgccacmsaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaahacaaaaaggagaattaatgatagggttcaagaaacagttaamattaattgatgttttaaaaaggcaaaagatgcatattgaagctscaagatgctatctttcactgaggaggaatttatga

SEQ ID NO: 32958 - DNA, 264 bp, Homo sapiens
caggggaataagggtggctttgatccagcctaaattgggatgtttccagcccagggagggtttattgagtgtggggagaggtcatagcttctcaaggagctggtgggaagaccaggcccacctgcctcctgtcctgaagggggttatgcagatgagatacaaatgagggcctgatcctcagccccacccaactctccaaaagccaacttgcacagcgagcatttagattgtctctgcagccagagactgtgtgaaggggggtgc

SEQ ID NO: 32959 - DNA, 335 bp, Homo sapiens
  misc_feature 252: d=a or g or t
  misc_feature 255: h=a or c or t
  misc_feature 257: s=g or c
  misc_feature 299: r=a or g
  misc_feature 316: w=a or t
aaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcatdcthcsggttcaggaatcactatgtatttccttcttgtgataaaaatraaattacgagaaggcawtgtgaggttttagtacatc

SEQ ID NO: 32960 - DNA, 287 bp, Homo sapiens
acaaaaaacccagaaacaatagaaaaaagtggggatctcagccgctggggtggcgggaggagcggcaacagccaggtagcccagctccacagaggctcacacaccagggcttgcaagcactgagcaccaggcaggtgcctttcctgctgccaagaagcccaagtggaaagtcagctcagcagaaggggaagtgaaggaagagcccaagaggagattcttgcaattgtcatctaaacctgctcctacaaaagcagaaatgaagccaaaaaaggcagtcatgaaaggac

SEQ ID NO: 32961 - DNA, 393 bp, Homo sapiens
tcttgactttgagcgtccggcggtcgcagagccaggaggcggaggcgcgcgggccagcctgggccccagcccacaccttcaccaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatgggtgagaggccctagaggcaccctcagtgggcacacatgcatactcatgcatgtatacacgcatgctgtgctgtggggcacgtccagcaggccactcctacacccagatttgactgtgtgtgcgctcagccactgtgcgtctctcccaccca

SEQ ID NO: 32962 - DNA, 253 bp, Homo sapiens
cctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctcagccccc

SEQ ID NO: 32963 - DNA, 393 bp, Homo sapiens
  misc_feature 96: y=c or t
  misc_feature 97: y=c or t
  misc_feature 98: m=a or c
  misc_feature 253: v=a or c or g
  misc_feature 393: s=g or c
ttagtcatctcagctggtagttctatacgatgagttatctcaccacttaaaaataagtacgctgctattttgagatttaaaaatatatatagtgayymgatttcttaccctagttaaagcaagccatggctgaaactcagattaaacaatattctataaaaatgagaaggccactctaatcaacagatagaaaaacagaactatagacataagggagagctgtgctaagggacaaattgttggatttgtaggvtttgttcgtatcctgaaagttaaatctttgtactcttaccttgtttatggccagatttgcctgatccctgatttccctcccaactggatcagaggttgtggaattggaatttcaccatacaaacctttacttaaaggags

SEQ ID NO: 32964 - DNA, 392 bp, Homo sapiens
  misc_feature 44: w=a or t
  misc_feature 197: n=a, g, c or t
  misc_feature 364: r=a or g
  misc_feature 381: r=a or g
  misc_feature 392: h=a or c or t
taatgaagtcccactacagaatttaacaagagagtgatttgtgwgaataactccctctcctaactgttctgatccagtggcgtaaataagatgctgagcaccactcctgctgggttttttaatgctgtttcatttgattgagacccagtagctttttggcctatgattcttggctgttttgttttgttttgttttgngctttccctagaggaataaagtaaagaacttcttgtgtacttatagcttaaagaaacagccattgtaaccctaacgactgatgaatgtgtgggattctcttagatttctttcatcgacgaaaaaagatttggggttgctttcagttatttcaaaaaaacagatataratcataaaaattaatcraaagaaaggch

SEQ ID NO: 32965 - DNA, 386 bp, Homo sapiens
ttttataggagcattgtcttcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcgg

SEQ ID NO: 32966 - DNA, 374 bp, Homo sapiens
gaaactgaaggactgattgttgggagtaggtctttgggcgagtctgtgagaagagttcttaatgagaactaaaaaggttatttctgttcttggtgtcccaaactgctctggtattttgccaaatactacagatagtaaaattcttaattaaagctgacatggttatatttttaaaaatttaggtgcaattagtctttcaagatcagaagatatttagttagtatcatagttcagtctgttccaagctgtaaagtcagttatttcagtaatgtaatttctaagatctataaaaaatgaaaatattttattttcttatataactttctgtgagagcattgaacagtcaagaaacttgtatgttttccagcccccga

SEQ ID NO: 32967 - DNA, 259 bp, Homo sapiens
agtgtgagcaaaggtacatggcatattcccagtgtagattaatggagcagtggatccctggggaaagtctagttggggataaaactggagaggttaagaatttgatccatgggaaattccaccattttagagcaaaatgtcacgtctgcaaggtcatattatatgattctgactctggcgacagcattcatgagggctagagtagttagcaactggagggaggcatgttaagatttcagagtagtaatttaacccgaaa

SEQ ID NO: 32968 - DNA, 75 bp, Homo sapiens
  misc_feature 2: k=g or t
  misc_feature 42: r=a or g
  misc_feature 56: r=a or g
tkaaggttctcacaaattcagtgtatttgtctccatacttgragatagccagaggraagactcaatttccttcat

SEQ ID NO: 32969 - DNA, 418 bp, Homo sapiens
  misc_feature 223: n=a, g, c or t
  misc_feature 224: n=a, g, c or t
  misc_feature 225: y=c or t
ttagtagagatggggtttcactgtgttggccaggctggtcttgaactcctgacctcaggtgatccacctggcttggcctcccaaagtgctgggattacaggcacgagccactgtgcccagccaaacatcaccatctatttcctttaggtcctaaaatatgcatattctgtcgcggctcgtcttggctttgccactgactgtgtgagcttggataagttatttnnyctggcttttgggtgcttctgctgtgaaagaaggggattaggttaaataattttctctgttttctactagctcaataaattatctgattctgtaccaagattacaagttaagaccaacttctttgtctggtcatctataacctattgttacaaatgaaataagaaagtatggatagaaagtattcgcttgcact

SEQ ID NO: 32970 - DNA, 325 bp, Homo sapiens
  misc_feature 176: k=g or t
  misc_feature 178: b=c or g or t
  misc_feature 179: k=g or t
gtctacctctttaattccagcaggcagatgtagttctgcctgcttccttccaaggttaagttcataacagttcagaatcttgcaagctcacttcagggtataacctgtgtctccaaccctgcagtatttggatattgctgtttaaacagtagatttggcatagatgatggtggcakabktggttgtaaaggaaaagaagcagaacacctcagtttgttcaattctctcattggggttttcagttgtatccagaatttaaaacagtaaaatttaagagtgtgaacagcaacattcacactttgtttagtaagtacaaagttgtgct

SEQ ID NO: 32971 - DNA, 244 bp, Homo sapiens
aaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacaatagac

SEQ ID NO: 32972 - DNA, 169 bp, Homo sapiens
tattatatagagtacagaattatacagctttctggagttcctagtatgcctgctgtcagctggcagcaataagaaagacccttattcaaattatttaataattcttcagtgtattctaatttagatacgtatgtcctttaagatatttacaaaccatttgggggccttt

SEQ ID NO: 32973 - DNA, 244 bp, Homo sapiens
  misc_feature 69: k=g or t
  misc_feature 76: k=g or t
  misc_feature 97: w=a or t
  misc_feature 167: k=g or t
tctgtttctagtttcctaaaggtaaagcttagattattgattttagctcttttttcttttctaacatakatatatkcagtgctataaatttccctgwactgctttcattgcattttacaattttttattgatatataatagttgtacatatttatggggtacatgtkatattttgatacatgcatacaatatgtaaggatcaaatcaggataattgggatatttatcaccccaagcaatgatca

SEQ ID NO: 32974 - DNA, 402 bp, Homo sapiens
agtttcaggtgttctctatctattaggagactgcctttccctggcaccggctgtggccaattattattttagaaagagagtcagcaaccgcctgaccatcacctgatggtcacctgacattccagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtaccggggcagcatcgt

SEQ ID NO: 32975 - DNA, 159 bp, Homo sapiens
gtggagtcggccgaagctttcggcggcggctgagccagctgaggggaaaaatggctcggactgtggcggcttcggcggctcaggttgtggtagaggcggaggctcaggcagcttgaggccttgctattttggaagctacaagaaaaaaatagaggacaa

SEQ ID NO: 32976 - DNA, 380 bp, Homo sapiens
  misc_feature 33: h=a or c or t
  misc_feature 34: w=a or t
  misc_feature 91: y=c or t
  misc_feature 92: n=a, g, c or t
  misc_feature 127: w=a or t
  misc_feature 304: w=a or t
  misc_feature 306: w=a or t
  misc_feature 307: k=g or t
  misc_feature 328: w=a or t
  misc_feature 345: r=a or g
  misc_feature 375: w=a or t
tcaatatgtgttagctaatagtaacatggtcthwtttcaatgaatctaagatgaccgcttgcaagtcataccattgttttatgtactacgynaaaagaaacacaggtaattatattgcaaaatgtgwttcatttgaagatttcaagacatatgaaaaaatgtgtcttgaaatcaatgatatatggttttagggctgcctctgacttggaagtcctgggaattgtttgcatactcataaatatacaccatctgtcttggtttaaacataatagagtatgatctaaagtttcttttcaattttgtwtwkgttctaaacttaacattgaawttggcctcgtgttgcarcactagaaatttaataatcactcatttatwctgta

SEQ ID NO: 32977 - DNA, 111 bp, Homo sapiens
tactatttttttaaattaatcttaattttagagactataaaaggagagagattacatataggaacttttccttttggaaacaattaaaattgtgtgtcttatacgggcaga

SEQ ID NO: 32978 - DNA, 145 bp, Homo sapiens
  misc_feature 138: b=c or g or t
ttacattcttatttcttttgacattttggaaataatcataacttgtctttccaaaataaccattttcttgatggaactcttcctagagtttttaccaaatagctaactttagtagtaaaacctcattgtgtatccatbcccccac

SEQ ID NO: 32979 - DNA, 458 bp, Homo sapiens
  misc_feature 129: k=g or t
  misc_feature 225: n=a, g, c or t
  misc_feature 226: n=a, g, c or t
  misc_feature 227: s=g or c
  misc_feature 401: y=c or t
  misc_feature 402: r=a or g
  misc_feature 419: m=a or c
cagttctacatttaaaaccctgcaatggcttcccagtgcctagatccttatgacttctccaacccttatgaaccattcttcctctcctgggccttctctgtacctgccacagtacacgtgttgtgctakaagcacacgtctctgacatcactccccaaaccatctccaaagaagccagctcctctgctgaactaattcctccttactcttaaggtctttgtttannstcacttcctcaaaaccaggttaggttgtcttattacaggatcccatgctattcttatcatcaattctctaaatcaggggtcacaacttaaggcctgtgagccaaataaggtcacccccattcatttacatgttatgtatgctgtgctacagtggcagatttggccctatagagyraaggaaaggtttgccamccctgtgctagagcaggaactatgcgctcctcaatgtgt

SEQ ID NO: 32980 - DNA, 377 bp, Homo sapiens
  misc_feature 48: d=a or g or t
  misc_feature 345: b=c or g or t
tccgtgtactgcctctcacctgcgaacttttgatgatgggcccatagdaagtaatagacttctaggggttttaatctgtttgacagttgattaaagtgaggacattgtgttcaatgtcttctcagtacccactttattgaagagatgaaccagcctgaccttttttctctgtactctttagggaaaatttttctatttataaaggcaatacatgttttagttttgttttaattttagaaatgtaaaaggaaataatacagaaaagtatatagaagaaagccaaggatccccaatgctactatccagagacagtttaccaattttgacctctatattagcataatbtgacataaatggagtcaactacatgcacccta

SEQ ID NO: 32981 - DNA, 308 bp, Homo sapiens
  misc_feature 75: s=g or c
  misc_feature 167: d=a or g or t
  misc_feature 207: h=a or c or t
aactgcagcagagttcttgctttccggcaggtgatggcgccccccgcggcctagaggtccagcgcccgccgcgascagcggacagtcctcctgttgtgtccgaccgagagtcctggtgactttgaacatgctggtgccgctagccaagctgtcctgcctgggtgagdggaaacgggcggtggggataagtggaggagttagggcaahagggacaaggccggtcctgggggctgtaggcacctctcgccccttctctcatcagctttctcaggctatctagggcaaaggtcacgcgctgtcagcctgtt

SEQ ID NO: 32982 - DNA, 312 bp, Homo sapiens
aaacccacatggagtggatggtttaacatcaaacatagtgttgaatgcagtgatgtcactttgacagcagaatgattacaatgagatatgattacattgcacttggccctgtggtaagttaatgggggaaaaatgaacaaaggatagagattctttttgaaagcaaatggaagccccttggcactaagactaaatcagactaaaagttatggttgctgatcaattatatataaccacaaataacttgccttcaagggtgccttcacggtcagagtgggcattaccattggggagactaaagtggagaggaga

SEQ ID NO: 32983 - DNA, 372 bp, Homo sapiens
  misc_feature 97: b=c or g or t
  misc_feature 98: r=a or g
  misc_feature 101: w=a or t
  misc_feature 128: k=g or t
  misc_feature 129: h=a or c or t
  misc_feature 130: n=a, g, c or t
  misc_feature 139: w=a or t
  misc_feature 201: d=a or g or t
  misc_feature 216: w=a or t
  misc_feature 217: n=a, g, c or t
  misc_feature 241: w=a or t
  misc_feature 303: n=a, g, c or t
  misc_feature 304: h=a or c or t
  misc_feature 314: d=a or g or t
  misc_feature 315: v=a or c or g
  misc_feature 358: v=a or c or g
gattaatatggtgatagggaggcactgagtatggaggtgggatagagctgtataaattcctgagcttctgatgaaatggtattaactttaaacctabrccwttattatctaggccaacctcatatatkhntgttttggwcaggaagggatcttgggaggtcttccagtccttgtcctgcctctaggaaggacagtagctgdgacactataaaatcwntttggtgtttaaagtcagatcacwgatagtctactaattatgcaaattatacatcagaacaggcaagtggtgcattcaagtatgtnhataaggcatdvcaaacaatcagtttgaaattccaaatgtagaacatctttaggvcatattcaaaagta

SEQ ID NO: 32984 - DNA, 141 bp, Homo sapiens
attttttaactcggtacactttatgacaatgtgatatttaatttatatgtgaattagccgtgtttgttgcttatacatatatctatgtgtttttcacctatgtatgtcatttttttcatcttttttccttttttttttttt

SEQ ID NO: 32985 - DNA, 351 bp, Homo sapiens
tatttgctttttcttccattcattctttcattggatttaatttttatttaagtgactactactatttttgtatttgttttcctagtttgattttggatttctccctgtaagatatcctataaactctatatttggggaagactatttatatttaattttgtataaagtgtataaagccttataaaatcacatgtaaagatgtctgcatggaagaacactttatccactttctcccaaatttaacctttttccccatttggaaggagcttggaaaccttgaggaaggatttactagtttctattgttgacaaagtgctaaatattttaattactttggaaactgccccatca

SEQ ID NO: 32986 - DNA, 349 bp, Homo sapiens
  misc_feature 318: d=a or g or t
atacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagadcaggaagtatagtttggggggtcggggaggg

SEQ ID NO: 32987 - DNA, 238 bp, Homo sapiens
atgtttttcaaattattttcaataagagaagttttttaatgattatatgcttataataataaattatttttaatagatcgttttgactacatggcattttaaaaataaaatattggcctggtgcagtggctcacgcctctaatcccagcactttggtaggccagaggccaaggtgggctgagcacctgaggtcaggagttccagtccagcctggccaacatggtgaaaccctgtcgca

SEQ ID NO: 32988 - DNA, 302 bp, Homo sapiens
  misc_feature 184: m=a or c
gatccagagcttagtctagcagtagtaaactcaccagtgtgagttaagtagagaagtcaagtgacttgcttagggaaaggcattcattaagtattttttaaagaatatcctactttgtcaggcgttgttttaggcattgtgaatacaatggtaagaaagactagcaagatcgctgttcttatgmagtttaaattctagtgagtgtaagatagaaaataggtaaactatatgagcaaggaattttggatagtaagcacagtgaagaagtaaaacagtgtaaaggtcttccttaagactggggg

SEQ ID NO: 32989 - DNA, 274 bp, Homo sapiens
ttttgaaactattcctctagattctgaggtactataattccttgtttctttcctgtttctagggctagtctcttcctcttttctgtaggatattccctttccttctgttgcttaagtgtacctatacccccaggctgtatctttagccttcttcatttcttgtcttgtgctctttttaagtggagctctcatttgtatggctttcacatttatttctacacaggtaattcacaaatttatgtgtttacttacaataatctgagtttgcgcccat

SEQ ID NO: 32990 - DNA, 234 bp, Homo sapiens
cttcctgtattttatgtgcatcatagtgatttatctgagcttagtgacccccatcttgtaacctgttgcaagagtgaatgtaaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgacca

SEQ ID NO: 32991 - DNA, 347 bp, Homo sapiens
aattgtagctcccataattcccatgtgttgtgggagggacctggtgggagataattgaatcatgggggaagtttcccccatacggttctttggtagtgaataagtctcacaagatttgatggttttataaggggagacccttttcacttggttctcatttctctcttgtctgccaccatgtaagatgtgcctttcaccctctgccatgactgtgaggcctccccaaacacgtggaattgtgagtccattaaacctctttttgtttataaattacccagcctcaggtatgtctttatccgtagcataaaaacggactaatacatcatgccactgcaaacaacaacaac

SEQ ID NO: 32992 - DNA, 406 bp, Homo sapiens
aatatatgtgtgtgtaaccacattcaggtaaaaaattattgccagccttttactcccttttccatcatcttgacttctgtgacagtcatttccattaaaaaaaaaattttactccctattatgtgtctttaaacattaggattagcttttgtatagttttaaactttataggaatagaattatactgtatatattcttttgtgacaattgatctgtgacaaattgacattgtagagcaacggggaagagacactttttcaataaatggtgctgggtcatttgagtatccatatagggaaaaataataatttgcttcacacaataaaaaataatttcaagtggatttatagatatgaaaagattaaataaaactggtataacggtgtttaatagaaatatattgtga

SEQ ID NO: 32993 - DNA, 326 bp, Homo sapiens
tactattgctgttaatttgcattgttaaaaattcttaaagtttaatatgttatgttcagtcattgaaagcgaccactcatttttttcttaaagttgatgccttttctgctgtgctagagtcagtattttgcttctggcaggagagctgcaaactgtgtatcctcaaacagatgcaaaaagtagtgctttgcaaaacgtttgttttctgtttatctcagattaacatcctttaatacaagtttcttaagtgtaacttgtatttctgaaaatgcttaaaattattttatatttccctttgggaatttttctctatttccaacacgctg

SEQ ID NO: 32994 - DNA, 186 bp, Homo sapiens
aagaactcatgtatcaaattgtctttaagtgcaaatacagttttaaaaatattttagtttttcatgcatggcgttaaatagttctatgagatatgttacggaaaactatcctctactcacatacacatcatattctgcttccagaggtaagcaatttttgctcatttagctgattcttagggactg

SEQ ID NO: 32995 - DNA, 198 bp, Homo sapiens
aaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaactca

SEQ ID NO: 32996 - DNA, 395 bp, Homo sapiens
  misc_feature 174: d=a or g or t
  misc_feature 175: h=a or c or t
  misc_feature 201: d=a or g or t
aagaggcgggggcttcctgcttcagcctccttgggcagaagcagtgaccacaggcccccatggcaggcagggcgggtgggaggagggtgatttacaaggcagatgggcctctggctacagctcagtcctgcactcagccagggccaccccaggggctataagagcaactagatdhctggagcagctcggggatgggtgccdtttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagtt

SEQ ID NO: 32997 - DNA, 287 bp, Homo sapiens
tgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgaaac

SEQ ID NO: 32998 - DNA, 418 bp, Homo sapiens
  misc_feature 400: r=a or g
cattactgtgagatctaaaccttctcaagagaagaggggacaatgagtattttctgtatgcttgttattagttctttccccaggggtgttaaatcagtgacacgacagctaagataaacatctagggagcttggctcttaggtctgcatttgccacattgctttcggaaagcaggagatatcctttctgttgacttagagtttgctgcaacagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggrccatttgcactgagtcca

SEQ ID NO: 32999 - DNA, 217 bp, Homo sapiens
tattcagtgtccattagcattaatccaagggcaagagagggagaacgtcatacttggagctctagaacgttatagttggtgggaagacttatcttgctcattgattttttgaaggaatattacatttattttcaagtctaggtttatattccatgaacccagaagcttggataggaaatactgaactttgcataacatatagttttgttgtcagccc

SEQ ID NO: 33000 - DNA, 261 bp, Homo sapiens
  misc_feature 222: y=c or t
attttttcgagtaaaaatgtatcctgtagaagattttgaagcatcatttcaatttatgcaggtgatataccttctaaatgacagtaaatagagcaagcctaacagtccttgctcttcatgactttttaaaagaaacaaaatacacgtaaattaatggcatcatttttagtctcttattccatgtgttaagttgttctaagtgtaaattaatttttttttttyccttgagacagagtctcactctgtcacccaggctggagt

SEQ ID NO: 33001 - DNA, 147 bp, Homo sapiens
tggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaa

SEQ ID NO: 33002 - DNA, 400 bp, Homo sapiens
  misc_feature 312: k=g or t
catttgggtcttaacaatcttccaaggacaacaattctgcctccctgggaagcctctaacatctgtatatattcagctccactgaatgttgcatgaagtttcattgtagaaaattgacacatgccttctgattaatctgttttcactcagtcttgtaaagggcacaccctgtagtttccatttgttcaatcatgtattttcctgctcacttaataaatctttttaaaaaataaagaaggaagataacaaaatgatgtcatatgaagcaatataacagtgaaagaattttttttttggtcctcattacttttkgtgtcttttcacaaatctgttgagattaaggatagtgtgtaattcatgctaaatagctaggatcaaggtcttcacctttccaggacct

SEQ ID NO: 33003 - DNA, 63 bp, Homo sapiens
  misc_feature 54: k=g or t
tagactctgaaaaatctcatccatttccatggccttggtttctaactgtatatkgataatttc

SEQ ID NO: 33004 - DNA, 305 bp, Homo sapiens
  misc_feature 102: k=g or t
aatatctttttttaaaaacctagaaaatgtatggacaaattcacaactattgcccaacttaacaatacatctttatcttaaatctaagcaaagtagaggttkgatttacttatttatagatttatttctttaacctgtcatttttttaatcccagaactgcaaatctaattatccaacaaagggaaacagaatctccatcttccagccttctaccacgatttagattatatatttgggatcaggacaggagacttttgtctacctgccagccagagagagactttacatttagcagacaccccac

SEQ ID NO: 33005 - DNA, 424 bp, Homo sapiens
atccgtcggcgccacagccccgcgcggaaacctcaggcaaagacatatggcatccaggagaaagatgtcttgccccttctccagataatggaaatctttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagctaccaaagagaaggaaccggtttctttatggacactacatccatggaggagggt

SEQ ID NO: 33006 - DNA, 235 bp, Homo sapiens
  misc_feature 102: m=a or c
  misc_feature 105: k=g or t
atttgaaaattaattaaaaacaaagacatgaagaatgcaaacccattttgttttctgttactagactcaataggcacaagattgttctgtgaaattgttaamagktttctaagtgcctgcttttgatttctgaaattagctctttgtgggctccttacacccccagaagcaagagtgggcctcactttgcccagtgctgatggagaatttaacggcagctccttgataagaccct

SEQ ID NO: 33007 - DNA, 155 bp, Homo sapiens
  misc_feature 144: w=a or t
agcctgcttttaatgaatgggaatagatttgccctagggggttttgggtaaattctgaattcaaaagtgaacattggggaccatcaaacacatgtccttttaatttataacatctaaataatcgatgttagactgtaataccawggccggggtca

SEQ ID NO: 33008 - DNA, 401 bp, Homo sapiens
  misc_feature 124: v=a or c or g
  misc_feature 207: m=a or c
  misc_feature 272: r=a or g
  misc_feature 313: m=a or c
  misc_feature 329: v=a or c or g
caccttaaaattcttgttatattttatttttatgagttgtcagatctatcatgatgaagcataaattctcatccacttatgctaaatatgtgctctgcctaagacctaggagaattagcagaavaaataattaccatccttcccatgatacaatacaatgttattttccatttttccattctgcattcaatgagtattaataataamaatcacttccaatatagagtactatgttagacccagtgaaggttgctaaggtataaaacttccartcctttctcaagcagtttattttaaaataataatgattatmgtaaacatgtattgavacttaactatgtgcctgcagttatgctgacatacttaggcacaccacatgcattacctcatttaacacaata

SEQ ID NO: 33009 - DNA, 357 bp, Homo sapiens
  misc_feature 97: k=g or t
  misc_feature 102: s=g or c
  misc_feature 106: r=a or g
  misc_feature 125: r=a or g
  misc_feature 277: m=a or c
cttgtgaaataaaggccctgataaatttttaagatatgctctagttctaaaagttattagttttgataacagtaacaatattgtgtaactgtgtttkatacsaagragcataattggcaaggtaraaaaaaatgcaaaaacttagtgtcaacaagggcctgaattaaacaaataaaagcactgagaaagtagaatagaaagaagccaaataacagaagagtcataatattagctaatatttatagatctgttaagttagatctataaatataatgtmatattattatacattatgtttgctgttagattacattattactctatagtaagttttcagggaatttcttaaaaccatac

SEQ ID NO: 33010 - DNA, 336 bp, Homo sapiens
  misc_feature 106: v=a or c or g
  misc_feature 110: h=a or c or t
  misc_feature 111: m=a or c
  misc_feature 116: s=g or c
  misc_feature 124: m=a or c
  misc_feature 146: k=g or t
  misc_feature 147: r=a or g
gtgaatgaagttgttagagtaatggttggtagatctgttgataatcagtaggggaactgctttggaattttaagtggaagcagtattttacacttttttttttaavgaghmcagastctcattmtgtcgcccaggctggagtgtakrcatgatcttggctcactacaacctctgcctcccgggttcaagtgattctcccacctaaattcccaagtatctgggattaagggcgcctgccaccatgcctggctttttttgtatttttagtgagacggggtttcaccacgttgtccaggctggtctcgaactcctgacctcaggtaatccatccgcccc

SEQ ID NO: 33011 - DNA, 77 bp, Homo sapiens
ggtttgaatgagactcgtcgcaccgaagccgccgccaccaccgcgcctccgcctcggccgccgccgcagctgctcct

SEQ ID NO: 33012 - DNA, 340 bp, Homo sapiens
  misc_feature 63: v=a or c or g
  misc_feature 126: r=a or g
  misc_feature 172: k=g or t
  misc_feature 213: w=a or t
  misc_feature 249: w=a or t
  misc_feature 274: m=a or c
  misc_feature 281: r=a or g
  misc_feature 285: y=c or t
  misc_feature 299: v=a or c or g
cctttaaacttagcatttgtgcttggtctgaattgttttactttagtgaacattcagtggtcvtttataaactcagtatctccttatctaatttctccataataaatttcttgttaacaaattatrttaccatagatgtttttaggagcctatccctcagaattgaggagtkactatacagtttggttatactgatttattatactgattgtwtttagtaacatatggagagagagttaaataattgtwtgcttttggagttgcagtgaactamaactgtrtttyatacaatataagtvccgctctatctctaacttgtttcttagcacacacaccttaa

SEQ ID NO: 33013 - DNA, 215 bp, Homo sapiens
aagatctagcatagtataaaacttcttatagacattcataatgtttttcattctttctaacaccaaacctgttcttcatacctagaaagatttggcttgcagtaggccctatgtgattattgaaagaaaagcataatacatttgagtcccgtaaaaagttttgagatactagtttaaggagtttaaatcttatcctttagcacaaggactgggat

SEQ ID NO: 33014 - DNA, 308 bp, Homo sapiens
gtgattggtgtacctgaaagtgacagggagaatggaaccaagttggaaaacactctgcaggatattatccaggagaacttccccaatctagcaaggcaggccaacattcagattcaggaaatacagagaactccacaaagatactcctcaagaagagcaactccaagacacttaattgtcagattcaccaaagttgaaaggaaggaaaaaatgttaagggcagccagagagaaaggtcgggttacccacaaaggtaagcccatcagactaagagagatctctcgacagaaactctacaagccagaaaa

SEQ ID NO: 33015 - DNA, 68 bp, Homo sapiens
ttacgtcagcacgtggggtggcgccgccccctgcaggatcccggtccacgcggaggagtggggctttt

SEQ ID NO: 33016 - DNA, 440 bp, Homo sapiens
tgtatataaagccattttgtggcaattgtttaaccagagttatttttttatctggggctttctaggagccgaacattaatgccagatcaagttggcctaacagtgaaaagcatgttgaccaggaggatgccattgaggcctatcacggggtctgccagacaaacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagattacatgaaga

SEQ ID NO: 33017 - DNA, 90 bp, Homo sapiens
  misc_feature 2: y=c or t
  misc_feature 5: y=c or t
  misc_feature 6: y=c or t
  misc_feature 8: y=c or t
tyttyytyaacccccacactaatggcagacattagtccttggtgagtacggggaaggtagaattgagtacatttctctgagcctacaaga

SEQ ID NO: 33018 - DNA, 332 bp, Homo sapiens
  misc_feature 51: m=a or c
  misc_feature 81: v=a or c or g
  misc_feature 91: m=a or c
  misc_feature 94: r=a or g
  misc_feature 100: m=a or c
  misc_feature 169: n=a, g, c or t
  misc_feature 233: y=c or t
  misc_feature 235: r=a or g
  misc_feature 300: m=a or c
tttttgcttgcttgactgttagtaatttacatactaactggttatgagggmagaaatggtaataatttcttcatatttgtvataattagamatrcatacmaaactcagtagcttcattgtgacacaaagaccactggagttctgtcctttggtgagcctgttattccantcgtaatgcatttatctttagattgggtagggtgggatttgcattgagttacaatgagttttcygrtccttatcagtcagtattaggagtgactgtttttaatagtgataatgaggcagctattcccaggmgaagaacttagtcacaggcagaattgtcagaa

SEQ ID NO: 33019 - DNA, 98 bp, Homo sapiens
tttctaggtatacaatcatattataatgaaaacagataatttgacttcttttcttacatatatgcctcttatttcttcctcttgctcaattgctccct

SEQ ID NO: 33020 - DNA, 265 bp, Homo sapiens
  misc_feature 102: r=a or g
  misc_feature 103: s=g or c
  misc_feature 105: s=g or c
  misc_feature 115: y=c or t
  misc_feature 145: n=a, g, c or t
  misc_feature 147: n=a, g, c or t
atcaagtttgtcttgttgggccttgagtttatgattattgatttctacgatggtattgtgtaagcgtttaacctcagcttctactttaccagctttcctcarscsacagcatgayattctgaaattaaaaaataaagaacctaantngtgtttttatgctaatgaacatcatttgttagatgtacatttcttcagttgctatgacttgacgtgatgcattaaaacaaattttaggcatatgggaaaaagcaccttaaaaaaaaaa

SEQ ID NO: 33021 - DNA, 420 bp, Homo sapiens
  misc_feature 41: r=a or g
  misc_feature 100: r=a or g
  misc_feature 245: n=a, g, c or t
  misc_feature 273: n=a, g, c or t
  misc_feature 277: m=a or c
  misc_feature 374: m=a or c
  misc_feature 385: r=a or g
  misc_feature 386: n=a, g, c or t
tgatccaggaaagtctttgctgaggacaggccagcggagcratcctttgtagctgagccagttttgagaggcagatataaacgtctgccagccatactargtgctccaaagctggaagccatagctggaagttctagtgagaacagtagagggggaggcttgggagagggaggtggaaacgtaggatggggccagcacccagtggctcacacacagctgctcaggtggtgcagacactcctgtcncactgcagcccagacttccttggtcttncggmaatgagaatttgctttatctgccaagaccctagatgctacagacgctgccggcccagggagcatgctctgagaacccctggactagaccacagagamctaggagcatrnacttccttttgtggaactgggagcagctgatggt

SEQ ID NO: 33022 - DNA, 369 bp, Homo sapiens
ggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatatagggaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgt

SEQ ID NO: 33023 - DNA, 204 bp, Homo sapiens
cataatgtgctcttcgtgggcaaacttgcctctttttagggagcagttctcaggaggaggtcatgactggcccaactgttctataggcagtccttaaatttctaccctaatggttatgtcagatcccaccgttgcttttaatattagttaacccaagtttgacagtttcctttgactgtattgggaggaacagaactcacgccc

SEQ ID NO: 33024 - DNA, 329 bp, Homo sapiens
agggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagagagtggatctttcctacaattgctgctggaagggaactatgaa

SEQ ID NO: 33025 - DNA, 205 bp, Homo sapiens
tatttccagttattgtaggttcattcagacctgcaattaaacaaattatccatgttttgagaatattgattttaaacattaaatgtttacatttctatatagagagaattcattctctgccccctaccaccagattttagccttaaaggcaagttatttagttttgcttattctcatacactgaacagttgtttagcaaatggct

SEQ ID NO: 33026 - DNA, 168 bp, Homo sapiens
taaacctgcagcaattttactcatatctcccacccttcatattgctagaggcaatggacatgtttcaaagctttctactattatttgctgtctttccaccttaattgaaacgttccatccttagcttctctggcgccattttctatctgcccttaaaacaactccatc

SEQ ID NO: 33027 - DNA, 413 bp, Homo sapiens
  misc_feature 69: m=a or c
  misc_feature 70: v=a or c or g
  misc_feature 72: h=a or c or t
  misc_feature 73: m=a or c
  misc_feature 85: r=a or g
  misc_feature 86: r=a or g
  misc_feature 198: h=a or c or t
  misc_feature 199: y=c or t
  misc_feature 293: k=g or t
  misc_feature 304: m=a or c
  misc_feature 305: r=a or g
  misc_feature 336: r=a or g
caagccgtttctctccaacatccagccacagtctccgctcctctccgactgagtctggggtttttatamvghmcaggatggggtrrggtgaggccatgggtagtttaggaaaaggcaacattcaagcaggaaaacgggatagaagttctcacgttgggccgcagttccaggtttttggcttgagggtggggttttcahyagggacctgcccttttctgcctagaatttctctgcctcctgtccccatcagttccttatctccatcatcctaaactgggacagtcttttctgtkacatgattgcmragcactgtataacttccttttacagcacttratcagaatttgttattagttattgttattgtccttccctcactagacaggaaactctgtcacagggatcgtgtctga

SEQ ID NO: 33028 - DNA, 342 bp, Homo sapiens
  misc_feature 79: r=a or g
  misc_feature 86: m=a or c
  misc_feature 115: r=a or g
  misc_feature 144: v=a or c or g
  misc_feature 145: r=a or g
  misc_feature 146: r=a or g
  misc_feature 314: r=a or g
cactggataccacaacacaacaaaagattggtggaacgagaatgcctacacgcagccacaggaatccagtttccatggraaccaamagcagttgcttgcctgctcagcaagttgraactgaaggagtggctccacataaaagavrrataacttgaggactgtaccatggaaaactaaatttaaaaaaccagttataacagtgtttaatttagataagtttgagggaaaataatcagtaggcaagaggaacatttttcctgtagtagctagagtgccttgaaaaaatgtgttggctatgtgaaggaatatttcarctaaaatggaatggtatgcttttcaccc

SEQ ID NO: 33029 - DNA, 141 bp, Homo sapiens
tggctgagctacattttctgatttgcctacagtgaacaggtaatggcttgtgtaaggaaaaataagtaaaatgaaaggagggtgaaaggggaagggtatttgtaacctattccacctgcaatgactctttttttttttttt

SEQ ID NO: 33030 - DNA, 194 bp, Homo sapiens
cgttacattgcctactcactctgacctcctgtctctctctgataaagacccttgtgattacattggccccactcaggtaatccaggatagtctccccatcttgagatccctaacatttgcaaagtcccctttgccacataccataacactaatgggttccaggaattagaatgtgaatgtctttgggaggccat

SEQ ID NO: 33031 - DNA, 232 bp, Homo sapiens
ctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaagccc

SEQ ID NO: 33032 - DNA, 151 bp, Homo sapiens
aatcttgacttagagttgccttgtaatgtagcctcccagtgggttctccttgcccactgcctagacacagccgatttatcaagacaggagagtggcaatagagaaatagtttaattcacgcagagctggctgtatgggagcccggagtggg

SEQ ID NO: 33033 - DNA, 184 bp, Homo sapiens
  misc_feature 76: r=a or g
  misc_feature 108: r=a or g
  misc_feature 141: r=a or g
cactcctcttctttcctttaacaaatgaacttttagcacttctgtcttcaaggaaaaacatttgtttggaattgargggtactcgcagtccgtttatagtttgggacrattaataggaaaatccccagttgcattcaaatratagtgttgatgttgagggcactgactcattcagcatgtctga

SEQ ID NO: 33034 - DNA, 130 bp, Homo sapiens
  misc_feature 87: m=a or c
acggagtcttgctctgtcacccaggctggagtggtgcagtggcacagtcccggctcactgcatcctctgcctcctaggttcaggggmttctcttgcctcggcctcccgagtagctgagattgcaggcacc

SEQ ID NO: 33035 - DNA, 383 bp, Homo sapiens
tagtgggatgtagaaagtgttttggaaagatgaactggaaacagttgacaagggaggaagtctttgcaatatcaaaagatctgagagcaccagtgcattggaaatggggatccaaggatcaaaaagaggacaacttgctaccttctaatttaagccaagatttgcttcctttgtgctttgcggagggaaaggtaatgaagggtagtgctaagcagacaggctcttcatgctttctcttaaacagggcagcctttttctaacaccctcatttaataattgagatatggtggttcagaaagggaaaatgacatagttaccagagtttctaagctttgccaactatgcagtttagtttgagaagagatgactcactggtaaagaat

SEQ ID NO: 33036 - DNA, 401 bp, Homo sapiens
  misc_feature 212: w=a or t
gttagaaatttttatagtttcagagtcaaaactagaaaatgaggtaaatttggtgaagtctagtttctatccttctcactttgcccttttctctcctttcccataggtaaacaatgtaattagcttttgatttatctttcttttgtgtctgcttttaaaatggaattaaatttgtattgttttcttagataaatgcaggcatactattgacwctgtccagcccctagtttttttcatttgataatatttcttagcaattacactataacattatatgaaattccttactagcagctatttcttatctggcatgggattaccatcataccatgggccccaaacctatctttagggtttgattggttatagaaaactttttcctacccagagcttttggcaga

SEQ ID NO: 33037 - DNA, 203 bp, Homo sapiens
gaacgggtctacctttctttgttccttccccattcttattctacatagtacctactgcactgtaacttatggttttgtgggagaaattccaggtatcttagaatacagaatcatataaaagagcagtaactactcatcttgagagtgattgcatttatttcataggtaagtaatcttggccatagctaatacacttattattt

SEQ ID NO: 33038 - DNA, 348 bp, Homo sapiens
aagaacattatattttcaaatggaataataataccatcagtgaaataaatgttaaaatttttagggcagagattaatgcccaccagaaaggtaactttgatgagggtagcaagcatgctttcactgaaaagtatttttttttcctcttttcaagattctcataattataacccataaaactaagttagacttgtttcttatgtgcatttatgatttaattaacgagagtacactttgtatgacaaaatgcaattttaaggtaaacactatggagaataatttcttttcctagtgaaatggtgcacgttatattttattttgttttatttctagggataatgacacagc

SEQ ID NO: 33039 - DNA, 433 bp, Homo sapiens
  misc_feature 10: k=g or t
  misc_feature 11: h=a or c or t
  misc_feature 328: n=a, g, c or t
cctagccttkhatagtctttacagattggcatgtttttgcagtggctggcaccggttgttcctttccatgtttagtgcttccttcaggagcttttgtagggcaggcctggtggtgacaaaatctctcagcatttgcttgtctataaaggattttatttctccttcacttatgaagcttagtttggctggatattaaattctgggttgaaaattcttttctttaagaatgttgaatattggcccccactgtcttctggcttgtagagtttctgccaagagatcagctgttagttagtctgatgggcttccctttttgggtaacctgacntttctctctggctgcccttaacactttttccttcatttcaactttggtgaatctgacagttatgtgtcttggagttgctcttctcgaggagtatcttagtggcgt

SEQ ID NO: 33040 - DNA, 213 bp, Homo sapiens
cacactacgaataataaatattacttaataaaaatgaaaaataatgagattagttactattgaactattcttgcttagaatgcccctgaatttcagtcatagaaattcacttgtacctgggtaagttacaagttcttatttgtgctggtttctgttccattggcaattaaaattttggtaagttgaataaaagatctttctaaaaaggggctc

SEQ ID NO: 33041 - DNA, 362 bp, Homo sapiens
catacaaataaaaatataattttaacctgtggcaagtgctcagacagaaaaaatccagttaggctgccagtaaaaatactagatgtggccggatgtggtagctcatgcctgtgatcccagcagtttgggaggacaaggcaggtggattgcttgaacccaggagtttgagaccagcctgggcaacacggcaaaccccatctctacaaaaatacaaaaacaaaacacaaaaattagccaggtgtggttgtgtgcacctgtagtaccagctacttgggaggttgaggcaggaggatcacctgagcccaggaggttaaggctatagtgagctgtgattgggccactgcactccagcctgggtaaca

SEQ ID NO: 33042 - DNA, 377 bp, Homo sapiens
  misc_feature 87: m=a or c
  misc_feature 106: r=a or g
  misc_feature 264: v=a or c or g
  misc_feature 294: m=a or c
  misc_feature 307: m=a or c
  misc_feature 314: d=a or g or t
tagttttactcttataaaatagttttctaatttctatttcattacctgtactattagttaatggagagatcctgttgcatttataamattaaaccagaagcgtgtrtcagacagttttctctaccttggtgccacaatattttgaaaacctagagttatacaaataagtaattacagatggcaaccatttttttcactgctttatcagccacatagtggtgaatcactgagaagagatattcagaatgctgctaaagcagctavatcatatgttggttttagactactattggmaggaatttggtamgtgtgtdttcttgttaacagttctcttgtatcatatcttaggctggaatggttgcttattcaatatatga

SEQ ID NO: 33043 - DNA, 159 bp, Homo sapiens
gctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacca

SEQ ID NO: 33044 - DNA, 316 bp, Homo sapiens
ctaaagattttattatatcctttgtatttggcaactaaaaatgctacttggtaattgtctgagaatatgtaactgtagaaaccattgaagggtgaacactccactaccatggagttgggaatgtatttctttgggaaatggaaaccatggcccatgcctgcagtggcgggagcacatctgtgcatttctggtggatgtctgtggtatatggctatatgaatacacggctgtgcacgctttcacaatgggaaaccgggaggccaggtagctggcagtgtttgagtgacagctgttcatgacacataaccccttaacc

SEQ ID NO: 33045 - DNA, 360 bp, Homo sapiens
  misc_feature 126: h=a or c or t
cattttgaattttgattgggagttgatagggtttggttctgtgtccccacccaaatctcatgttaaattgtgatcttcagtgttggaggatacacctgatgtgaggtaattggatcatgggggcahatttcccccttgctgttctcatgatagtgagtgagttctcatgagatctggttgtttaaaagtgtgtagtactttccgctttgctctcttcccctttctgacatgtgaacacatgcttgctttcccttcgcctttctgccatgacagaaagtttcctgaggcctcccagccatgctgcctgtacagcctgaggaagtgttagtcaattaaacctcttttttcataaatcatccc

SEQ ID NO: 33046 - DNA, 247 bp, Homo sapiens
  misc_feature 110: r=a or g
tgatactgtgggattttctgtatttacttgacagtcatggaggatttggtatgacttgaccacaggtttagaccaaggctgagaagaacagaagggagaaattaatggcraaacaaaaaatacacaaatctgcggttttggaattaatgaaacaagattcatctatttaaagaaatgttggtgttctaatacaaagcattattttcacttagagaaaattacttacttgctcccttctgtattgtaa

SEQ ID NO: 33047 - DNA, 342 bp, Homo sapiens
tagtagaaaaaacgctggattgtatgtaaaataaattatcctttctgctgttcctctcctcccctctaatctctagcaaattacttaaaaatttctcttgtgcccttagcatactcatgtaaaagaaacttgtcctaagcttatccttccacttttgcacagactttaattaaggaaaacacctgtcaaatgtcacaccctttaagggaaagcattaggaccaaggtgttattctgtggaattaaattttgtatcctttggaacatttttggaaaagttgtgtggtggttcaggatttgttaactccatatttaaatatgttttagattagagaatgccact

SEQ ID NO: 33048 - DNA, 242 bp, Homo sapiens
ctcagtcgaatggtaatggagctccaacgtgaatactgcaagtatcaggcaactcactacctgactttccagttctaaaccattctaattgctgtagagagaactaacctttgttgagactgttgagtgatggatgttttacacacttgctttcccagaattcccacctctggagatcgtaggtgtgggagctcagagggtggggagtggactgtccccatcacacagcaagagaggggcga

SEQ ID NO: 33049 - DNA, 139 bp, Homo sapiens
ttagttcagttatagagtcttttaaaaaatccttacttgcctaaagacaagcaaggtgtgggggaaaatccctgtactagtcaggaatactgactagtattgactagtttgagtcttgactcaaagccaaagtgggggt

SEQ ID NO: 33050 - DNA, 162 bp, Homo sapiens
tgtattttttgtagagacgaggttttgccatgttgcccaggctggtctcaaacccctgggctcaagcagtccacccacctttgcctcccaaagtgctgcgtttacaggcatgagctactgtgcctgaccctctttttccattcttttatctttttttttttt

SEQ ID NO: 33051 - DNA, 256 bp, Homo sapiens
agaagaggctgggagttccggagtccactgggcggaggttccgcaggtccacaactgcatgtggcctgtagcccccattctccacatttggaggggtgtgggtggcagaccagggctttgaagcggacctgcagatttccctcaaatccagctaaggcctgcgctggaagcagaaactgagttctcttggcctgccgcgaggaaacccgcgtcctgcccccacccaaggtgggtatctgggatccctacacaccgc

SEQ ID NO: 33052 - DNA, 345 bp, Homo sapiens
  misc_feature 27: s=g or c
  misc_feature 89: s=g or c
  misc_feature 101: r=a or g
  misc_feature 123: s=g or c
  misc_feature 137: s=g or c
  misc_feature 198: m=a or c
  misc_feature 300: m=a or c
  misc_feature 301: n=a, g, c or t
  misc_feature 316: s=g or c
  misc_feature 319: s=g or c
  misc_feature 338: s=g or c
atagacattaggcagtggggaaggtastcgtttacggggggagctgctcgggcttccgttcagtggttcccggcacgctcagggtgcastgtagggtctgratgtgtgtattgcgggggtagsgggagtggtgtcasttctaggccacaggaattcgtggtctggccccagaggtgcggtgtttttggccgggaagtmaggcagaagtctgcagcgtgcaactcgcagcggggcgtgtgtgtgcgtgtgtgcgcgcgcgtgtgcatgtttccggcccggggtcgcgtgtgtggctgtagmntgtctccgtgacaasaasatccagggatctacgggcsgcacgtc

SEQ ID NO: 33053 - DNA, 368 bp, Homo sapiens
  misc_feature 352: r=a or g
tgtctctatggattgacttattctagacacttcatataagtggaatcatacaacatgtagcatttcatgagctattttcacataccataatgttcttaaggttcatccttcattcttttttatggctaaataatattccatgtgtgaatacgcacattttgtttatccacatctgggaaggttccactcttggaactaatatggataatgttgctgtgaacaccatgcaggtttttgcatgaatatacgttgttatttctcttggatttgctagctgatttagcatgtttactaacatgccattttagttgtaaccaccattctttcacacttgggaactggttatccctgrctcaggatgcctcgtc

SEQ ID NO: 33054 - DNA, 139 bp, Homo sapiens
ctctctgccgctcctccgccccacggctcaggattcgcccaaaatgaggacttccctgcaggcagtggcactctggggacagaaggcccctccccacagcatcactgccatcatgatcactgatgaccagcgaacgata

SEQ ID NO: 33055 - DNA, 301 bp, Homo sapiens
cctggctatttctatgtttttaaacattattggtacttagagacttgtcaaatatctaaaaatgtgaattgctactgtttgacagatttttgggattccttctgttttgtgcagtccttaataatatcgtgctgcaaggctgtgaataatttacaaactggatatttcctatttcaataattgagtgttatctcttctgtatgatttagtgtccagatgaatttaatttaaaataaatggatttaaatgacaatgtaaattagtagtcaaaaaacccatttaattcttttcccccactgta

SEQ ID NO: 33056 - DNA, 159 bp, Homo sapiens
  misc_feature 114: k=g or t
ccttttcagattgttcattgccagtatatagaaatacaactgattttgttatttttataccctggaactttgctaaatttatttaatagctctagtagtttgtagatgtgagtkatttagggttttctggatataagatcatgtcattggccagctgcg

SEQ ID NO: 33057 - DNA, 260 bp, Homo sapiens
acagagccacagaatgctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaca

SEQ ID NO: 33058 - DNA, 391 bp, Homo sapiens
caatgactacagaacattagagtacattagtgggcttgccatagaaaatggcttctatacctttggttaccaactctgccttttacttcctgcatatttgtatatatttttacttattcagaagttttgtacattttaatttttattgggaaacagggttatatatattttttccttgtggagacaggctcttgctgtgttgccctggctggtcttaaatgcctcacctcaagcgattttgccttggcctcccaaagtgctgagtgtatgggtgtgagccaccacacctgtctagagttataatttcagtcttggaattattttctaaagagggtacagaagagcataacagggataaataatgtaataggcaacactgattgattattca

SEQ ID NO: 33059 - DNA, 214 bp, Homo sapiens
tttgcatagtgtatataactatgaccagattattttgaaaataaatcccagttatgtaagttttttcttagtatatttaaacgcatcaagtgctatgatagcttttatctacttgagaaaagtcccttgtggagccttctgaccggcttgatctgaacaggttaccccctgcacctgaagcatcacggtcagcctgggctatttttttttttga

SEQ ID NO: 33060 - DNA, 76 bp, Homo sapiens
  misc_feature 41: s=g or c
gtcaactgtggagggggcacctgtgaatgaatcctgcggastgctaacagagcagacttacacacacaacatacga

SEQ ID NO: 33061 - DNA, 304 bp, Homo sapiens
  misc_feature 271: r=a or g
taaggtagttgattcccaaggatagcaacagggaggaatgcgcaaggaatttggtaacttcatttttctctggtgtaaccattatttgtgactatgttgaagttagatttcttccctaaaagtggccttgctttcttgttgattcttggtttaaatattattgagcttaaatagtagttgatgttttactgagaagtgtgctctgtgatggtgagatgtttgaactgtaggagtgtgggagaagtgggatccttaacagagggaacactarttattatttgctttctgtcatctggaaggtatt

SEQ ID NO: 33062 - DNA, 141 bp, Homo sapiens
gtgggcgcgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcct

SEQ ID NO: 33063 - DNA, 238 bp, Homo sapiens
  misc_feature 212: r=a or g
acacaccccatcattcattcagcacaggaagtctctccatgggagccctccagcagggaaccggccttgccgtttgaagacctggatccttgtccctgatgagccaccacatatgggaatggccttgggaaacccacgtgattgttctcagcctgcttcttcgtctgagcagatgaagacgtcattttttcttatccagtttgaggatccarttagatactgcatatgaatgcccact

SEQ ID NO: 33064 - DNA, 366 bp, Homo sapiens
  misc_feature 257: h=a or c or t
  misc_feature 354: w=a or t
ttacagttaggtttagccctatggctattctcattaatagtaaatgagcagatattacgaatcccatctatgaactaaggatttaaaaagcacgttttctcccctaagttttcttcacctttctgccagcttcatgctgttaccattctggggtacagcaagtgccacaagatgaaagcaagcttggtgcatgaatcccacatgcaacagtgccactcaccaccagttacatacactcatgaccgattgttttacahtaacaagaagtacatttctttagtatttgatccattatgtatttttagagttctttttcatagtagttgagctactctatcacatgtcaagaacagwaggctctgtcaa

SEQ ID NO: 33065 - DNA, 229 bp, Homo sapiens
  misc_feature 156: m=a or c
  misc_feature 158: v=a or c or g
  misc_feature 166: m=a or c
  misc_feature 186: r=a or g
  misc_feature 194: m=a or c
aagcctcgccgccgccgccgccgccgccgcgcacgccatgggagccgtgactgacgatatagccagtaccaacgtatgctgagcacgctgtctcaatgtgaattttcaaatgggcaaaactttactagtatatgatatgaatctcagagaaatggmavattatgamaaaatttacaaggaaatagratgtagcmtagctggagcacatgaaaaaattgctgagtgcaaa

SEQ ID NO: 33066 - DNA, 168 bp, Homo sapiens
  misc_feature 34: d=a or g or t
  misc_feature 60: y=c or t
  misc_feature 61: k=g or t
ttcggggccggcgaggggaggggcacggacaccdgtacaggacggggcttcgcagacagykagcggaggggcttccccgtaagggcgggcttcgagggtcgcgtttggaaggccttacgaggggcccggtggaagggcggtgaagggcgggctaatcgggaggcggct

SEQ ID NO: 33067 - DNA, 137 bp, Homo sapiens
cttaaatgtcctgattctcactaactgcatttatgaaataaggatatcaacatctacattacagtactgtgcaggtcaaatgacctaaagtatatgaaagttcattgtaaactgtaaaatgcaatgcaaaaaccaca

SEQ ID NO: 33068 - DNA, 266 bp, Homo sapiens
caccctctgagccctgtggggaccaatcttagccttgacatcttgggatcccactgctccctcctctccccacacctttctggctccaggagtccttggaaacctctaaaagacccagaggtccttgtgccatcccacgacttggcctccatctgcacctcacctgacagcccagatttctcaactgagcccgcccaccactgtgactgcctctggcatacagataccctccgacctgctccagcagtaacaatgataacccccta

SEQ ID NO: 33069 - DNA, 177 bp, Homo sapiens
  misc_feature 11: n=a, g, c or t
  misc_feature 12: n=a, g, c or t
  misc_feature 71: s=g or c
  misc_feature 72: v=a or c or g
  misc_feature 160: y=c or t
  misc_feature 169: y=c or t
caggctgtgtnncctgaccgttggagcgtctgcgacccccgcatccccgcaccctcaaggcacctccaaasvgatgatgggttgtggggagtcagagctgaagtcggcggacggggaagaagccgcggcggtcccggggccacccccggagccccaagtyccgcaactycgagcccc

SEQ ID NO: 33070 - DNA, 219 bp, Homo sapiens
taaggatctttttttatcagtttcattttgatattttagatgtgaattcaatttggttgacagagtcttgctctgtcacccaggctggagtgcagtggcacaatcttggctcactttaatctctgcctcctggattcaagccattcttctgcctcagcctcccaagtagctgggactacaggtgcccaccaccatgcccggctagtttttttttttttt

SEQ ID NO: 33071 - DNA, 309 bp, Homo sapiens
  misc_feature 246: n=a, g, c or t
atcaaacagtatacccactaccgaaaaatcaggaaatatgggaagacaaagcagtttataaacctaatcaccagaagtaatccatgtcacagaattgaaatctaatcctcctgttttctctgcatctgcctgcgtgtacctattgccctgagaatagtaccccatatctagtagcccccaataaatatttatcaaatgaattactatgtatttcaaaaaggaatttttgaaatacatatgcttaanatgtgaagagttcccagaattctaatactacagatttggtacggattgttcagtaccaaattc

SEQ ID NO: 33072 - DNA, 70 bp, Homo sapiens
  misc_feature 13: s=g or c
  misc_feature 20: s=g or c
ctttttgctgtasgcccggstggttgctgccggtaagtagaagcttgggttgaatctttcaatctgctgc

SEQ ID NO: 33073 - DNA, 193 bp, Homo sapiens
gatatggtacggcaacatgaacaaaatagcacacatacacacactcaaattgagtttataaatagttttgaatataaaatgtctacaacttggttttggtttcttgtaggagcatatcatgtctgacatgtgatgggagaatccattcacatttaatattacaactgatataccgaacttttttccaccagca

SEQ ID NO: 33074 - DNA, 259 bp, Homo sapiens
  misc_feature 136: r=a or g
caggggaatgttaacttcccctagaaacagcatgacttgccgtcctctcagcaggtgagttacagaaggcctgtagagtaccacaagaaagaggcctgactacttatttggaaattagctgtttttgttctgcttrtggagggttccttgagaatttggccctttccctgttttataaggggacaaataaagatgagatagggaagtgggggtaggcattgcctttgttcatgggaccttgctgatctgcggggggctg

SEQ ID NO: 33075 - DNA, 262 bp, Homo sapiens
  misc_feature 219: h=a or c or t
gaggaagtggttctgccctgtgggttggctgaggctggggtgggctgactgggcatgtgggggagctgatgcctgctcagccagtccactttcaatttctagaacttcacgttccgcctgcattttgaacaactaagtagtacgagtaaaccccccaaggactgagctccgcttgatcttacagtcctccatgaactctgccagagtactgatgcagchtcacaggagatactatttagataagattgtccatggcaaggag

SEQ ID NO: 33076 - DNA, 485 bp, Homo sapiens
  misc_feature 311: n=a, g, c or t
  misc_feature 312: r=a or g
  misc_feature 339: v=a or c or g
  misc_feature 340: n=a, g, c or t
  misc_feature 341: k=g or t
  misc_feature 430: y=c or t
aagtgagtctccaaaactaagtgaaaaagatgtgttttgaagaaaagggagtgagcaactgtgttgagtgctgaagacaggtcaagtataaagagggctgagattggaccactggatttggcagcatggaggtacctgatgccaccaattcctgagtttttctgctgttcagtggagtggactatcgccttcaaattagcctggccctgggcaggaaatgaagaccctgaatcagcccatcagaagcaggagatccctttcgtcgaccttctcattccatctctatgctggagcattcttgtgacctaacnrtattgaaactgcctttgcaaaatattvnktgagacagtgaaagagggacgcccattgccatggcttgaggcctagagaagaggcccaatgaggcaaggaactgaagtcttcttcaagycttcctacatccagcaaggaactcaggtcttttcaatgagtgcagtcagctacca

SEQ ID NO: 33077 - DNA, 211 bp, Homo sapiens
tgaaactaatgagaacagagacaacataccagaatctctgggacagtgttaaacagtgttaagtgggaaatttatagcactaaatgcccacatcaaaaagctagagagatctcaagttaacaacctaacatctcaactaaaagaactggaaaatgaagagcaaataaaccccaaagctagcaaaagatcaagaaataaccaagaatagagc

SEQ ID NO: 33078 - DNA, 221 bp, Homo sapiens
  misc_feature 5: y=c or t
  misc_feature 171: y=c or t
ttttyagtagagacagggtttcaccatgttggcgaggatggtctcgatttcctgacctcgtgatccaactgcctcggcttcccaaagtgctgggattacaggcgtgaaccactgcacccggcttttctggggggcttttgggggcttttcagaacatataggcctgtcttycttgtagcagaaaacttacccaacagatgctgttgtaggagaatgcctta

SEQ ID NO: 33079 - DNA, 133 bp, Homo sapiens
  misc_feature 96: m=a or c
  misc_feature 115: m=a or c
  misc_feature 121: k=g or t
gaatctcgctctgtcgcccaggctggagtgcagtggagcaatcttggctcactgcaagctccacctcccgggttcacgccattctcctgcctcagmcctccccagggagctgggmctacakgcgcacaccacc

SEQ ID NO: 33080 - DNA, 131 bp, Homo sapiens
attttttttcagagactttcatccggcaaccgacggggctttttttcttaaaggagaagcgacagctcaaaatactacccccttctccgcgcaagatctggcggcgctggggacagaaaggccaaagacag

SEQ ID NO: 33081 - DNA, 413 bp, Homo sapiens
  misc_feature 187: y=c or t
  misc_feature 188: y=c or t
  misc_feature 189: m=a or c
  misc_feature 259: n=a, g, c or t
  misc_feature 340: s=g or c
  misc_feature 341: h=a or c or t
  misc_feature 391: n=a, g, c or t
tgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttyymgtagagacagggtttcaccatattggccaggctggtctcgaactactgacctcgtgatctgcccgccttngcctatcaaagtgttgggattacaggcttgagccaccgcacccggccgagaatatgtgttgttatttatgactggattatshagaatcaggagaatgcatttcatgtctgattctgctgctaattaagtcantcatttaatttttgggaccacc

SEQ ID NO: 33082 - DNA, 446 bp, Homo sapiens
caatagtacatatgaaagtgacctccaaggggattggtgaatactcataaggatcttcaggctgaacagactatgtctggggaaagaacggattatgccccattaaataagaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgc

SEQ ID NO: 33083 - DNA, 124 bp, Homo sapiens
caatatcgaattgattccttaccctttcctgaaagacctttgatagattctgagggtagaatgttgaccaggatggagctgggccttggagagtggggaaggcaggcagtaacacagcaggctg

SEQ ID NO: 33084 - DNA, 167 bp, Homo sapiens
gtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctt

SEQ ID NO: 33085 - DNA, 95 bp, Homo sapiens
ttgctttctcggggtaaaattcattagctgagtacttaacaaaaatgctagttactcacatattatttattttaaactttcttggcttttttttt

SEQ ID NO: 33086 - DNA, 135 bp, Homo sapiens
  misc_feature 95: k=g or t
  misc_feature 101: k=g or t
  misc_feature 107: r=a or g
  misc_feature 134: r=a or g
  misc_feature 135: r=a or g
caaaatagtaaactagtttgtgatatgtgtgcttttgttattaacataataaatactaagatttagaagaagatataataaatataatgtttttktgtttkttgagrcgaagtctcgctctgtcacccaagcgrr

SEQ ID NO: 33087 - DNA, 236 bp, Homo sapiens
  misc_feature 211: k=g or t
atgcacaccgccgtcagcttcaccacgctctcggccagcggcaccaggttcaggatggccccaaatggctgcgctcccatggaaagacagagggcgctcagccaccttaccaggtgtaacaccaccctgtgccgtggacatcgcatcttaggaatgaggaagcaaatttggaaaagtaaatgacctacatcagacagcatggtcacgaagkcggttaaattcccacatgcaactcc

SEQ ID NO: 33088 - DNA, 331 bp, Homo sapiens
  misc_feature 107: k=g or t
  misc_feature 113: k=g or t
  misc_feature 117: y=c or t
ttgagtattgttcattagtaatggtaattttcttttatacaattttataaaatttttgctcttatgtactgacttttctggtttataaaaatactttattaaaaagktgagaktttyccatttaattaacatatagcttacagatctatacaagatgtgattgtatttagagcatttgaagtactctttttctaattatatgaaaagcatataatttctgcctttttattctttaactcatggttactttgtcactctttataagtttgattttaatttttcccaggtgacctaaagaattaatgaccattcagaaataaagcaaaaagca

SEQ ID NO: 33089 - DNA, 401 bp, Homo sapiens
  misc_feature 105: m=a or c
catttagtctttgtgctcaaaaggagtagggaagcagaaaattattctgaatgacagaaatgggaatgaggggacagaagtgaggggtggtgtgagggactggamcccaagtgctcaccctggtgtagcagagcaggatcccagctccagctcactgctctccctggtccggggggtaggggatgtggggcctgaagagcctttcatccctctgcgagtcggcggtgagccccggcccaacctgggcctagcctgtgtggacagggtttgcgctaagaggctggattcttccatgagttttttgcttttagtttgcttctagagtttccatgcataagagtgttgtagtatagggatcagtagaggtactgggacattgaattctagctgagagggtgagg

SEQ ID NO: 33090 - DNA, 464 bp, Homo sapiens
  misc_feature 53: k=g or t
  misc_feature 102: r=a or g
  misc_feature 138: d=a or g or t
  misc_feature 259: h=a or c or t
  misc_feature 413: w=a or t
  misc_feature 422: w=a or t
ctgattggtgttaaggtggtaatttcccccatataagatttagaatcactgaktttgagctagatgaaatttttaaaatttctggttgtctcattagactgrtgaggttgagtttcttcttcatatgaacagctagtdaataacagcagagttctcactcagtgctcagtacttaattttccactgcaccacaactgtcttaactaaatgtgctgtatttttctttaaaagttaagagttctatttggtgttttcagghatatacgtgaaaagacatgccatgttttggtaaataccatcagagttgtgtaaaggcgtgtactaagtgcaatcttaatttgtggaaataatcttcatttacccctcctaaaactacactcagtataacactttcccataaaggtgtgtgcagwaaaaatgtwatattactccaacactggcaggagcacagcacagcagcctta

SEQ ID NO: 33091 - DNA, 338 bp, Homo sapiens
  misc_feature 109: y=c or t
ttagcaaatggacgtattagttttgtggaaagtttcagtgaactgcatactgaataaggtctttggagcaagcattgttattgataaggtttttgcataagttaatttyctaatctgaagtgatagtcttttgggagagggaggagctctttattgaaagtaaggttttaattttcatgctattgacatgcatagtctattctggattctttgggaaggtatgtatatcaagaaagtggataggcggttccttctttgctaacgctgggttcgaggctggggatggaggtggtgccactgacatggagacaggtctgagagcctccccagggtaggac

SEQ ID NO: 33092 - DNA, 244 bp, Homo sapiens
  misc_feature 106: m=a or c
ttttaggttcagggtacacatgcaggtttgttatataggtaaacttgtgacttggggatctcgggtacaaattattttgtcaccagggtactaagcatagtactcmaacagtttttttgtttgttttgttttttttagacagagtctcactctgtcccccaggctggagtgcggtggtgcaatctcagctcactgcaacgtctgcctcccgggttgaagtgattctcctgcctcagcctccctt

SEQ ID NO: 33093 - DNA, 373 bp, Homo sapiens
tattttcatttgcttctcttctctttctgctggtttggaaattagatgttttacttctggtctaaggttaagaaggacatctatttaaagtccaaagttggccaggtgcagtggcttggcctcccaaagtgctgggattacaggcgtgagccactgtgcctggacgacctgagcattttcttagtccatgtttatttatgttacccacgtttcttaatcccttgactcctgttctggctttgttgcctcctttctcctcagtccttcaacaggtcccttgatgacatggggctggctctggttttccaggtgtcccctcgtcccagccacctcccacagagctgcatggccaacctggttctgggcacaggga

SEQ ID NO: 33094 - DNA, 118 bp, Homo sapiens
  misc_feature 9: r=a or g
  misc_feature 23: k=g or t
  misc_feature 47: m=a or c
  misc_feature 82: n=a, g, c or t
gtttaaggrgcttgtagaaagtkgaaatcagaattttaatcctagamggaacttcagagattattggggcaacagttaaggnagtttagggccctgaaaagttaagaggactcagtga

SEQ ID NO: 33095 - DNA, 418 bp, Homo sapiens
  misc_feature 96: b=c or g or t
  misc_feature 97: n=a, g, c or t
  misc_feature 113: b=c or g or t
  misc_feature 201: n=a, g, c or t
  misc_feature 202: n=a, g, c or t
  misc_feature 203: n=a, g, c or t
  misc_feature 394: k=g or t
  misc_feature 395: w=a or t
taataatgtactttagaaacatttctgggaatcctgttctatcaagcttttgtatggcaacagtccctttggacatcttggtgacttcatttcaabnttgagtcttcatttgbagttaattgggccgaaccaggtcttctccggtttttcctcataaccatcacagtgccaggtgtatagttaagagttgataaatatatnnnttcccacagtgtttgctgaggtaaccaaagatgcagatcctcctagataccaggcattgttcagtgctgtggtgactagaaaccttagtaagatacaacccttctttttgagtcatacttttatttctgtatgaagttgaaacccaggagcctaaatttgaacagaaacagaggttctgacaggtgtatgkwcaagtactactgaggagtttagt

SEQ ID NO: 33096 - DNA, 166 bp, Homo sapiens
ttttttatgtattgttttactcctttttattcatacgtaaaattttggattaatttgtgaaaatgtaattataagctgagaccggtggctctcttcttaaaagcaccatattaaaatcctggaaaactaacggttgtgtccagttcataaaatgtttgtggcaaat

SEQ ID NO: 33097 - DNA, 330 bp, Homo sapiens
  misc_feature 108: y=c or t
  misc_feature 111: r=a or g
  misc_feature 114: w=a or t
  misc_feature 117: r=a or g
  misc_feature 128: r=a or g
ccaaaaatttctacgtagattttatgctttcaaaccatgatagtataaactcaatatgtttatttactttgtttcatataagttaatgaaaaaaatcttacatttgtyaarctwatrataccccacgraaatcagattgttttatttaggataacaggtgtatatattcattccatttgtcttatatttcttattaatttaacaaaggtaatttgacagaatatgtgccctttctgtgaaatcctctttcttccactagctaacattttttccataatatctgcatttagcacctctgacccacacatacttagatatatactcctaccc

SEQ ID NO: 33098 - DNA, 70 bp, Homo sapiens
  misc_feature 39: n=a, g, c or t
  misc_feature 40: v=a or c or g
actttatctttctctcacacatactctctctctctctcnvacacatacccacacacacacacacacacac

SEQ ID NO: 33099 - DNA, 206 bp, Homo sapiens
  misc_feature 17: r=a or g
  misc_feature 18: h=a or c or t
tactaagagcggaagcrhtggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggacccga

SEQ ID NO: 33100 - DNA, 145 bp, Homo sapiens
catcacaaaattaagcaaacagaacagccagtatttcaagacatactatatcattttccttactaggaatctggattttatgtatataaatttatatttgtatttcatttcctcacttttttctgttttcaaaaaacatggccga

SEQ ID NO: 33101 - DNA, 371 bp, Homo sapiens
taaaaatatttcactacttaattatgccttatatgtacttatgtctcaaacctaaagtttgtattttaaggaaaacctctttaactagtgaagataggatttgctaaagctaaatttaaagatttacccccagatacagctggctgaaataacatcagagaagcacaaaatccacgagcacctgaaaacctctgcggaacagcaccagcgtacgctaagtgcataccagcagagagtgacagcactacaggaagagtgccgtgctgccaagggaacatctggaaatgctgattgaccagctaaaaatcaaattacaagatagccaaaataacttacagattaatgtatctgaacttcaaacattgcagtct

SEQ ID NO: 33102 - DNA, 212 bp, Homo sapiens
  misc_feature 102: r=a or g
  misc_feature 105: s=g or c
tttgacagttaaataatttgagaacttctgcattttgggcctgtgctcttggaaatccagaatgtacattaacttatttatgcctagtgttccattaatggracsgctaagcatctgggagttctttatatctactgctcaaggtcatcgccaaggtctgatttttcaccctcaaaaaattgcaaccttagacataaatacaggagtcctta

SEQ ID NO: 33103 - DNA, 54 bp, Homo sapiens
  misc_feature 2: y=c or t
tyctgattattctcctaatagggactgtgtgttccttcccagcagatctgtttt

SEQ ID NO: 33104 - DNA, 347 bp, Homo sapiens
tttctgataaattgccaaaaaagtctcacaggtacgtgaatctctcagtctctaaaaatatgtcatgatttatttctaggttctaagtatgtattcacatttatacctacttttgtatttgtcactcttcttccttttcctgtaagtaggttcccaaaattgtataagcttcaggttcctccaaacttggacctgcccccatcactcatcaccctccagcattgtgttcagctacatgttactgtagtcaccagcatcttgggagtgtgatttataggtggagggacttggtgctcttgatcagaatgatgcttttacctttattcacactgttttccatcctccca

SEQ ID NO: 33105 - DNA, 129 bp, Homo sapiens
gttttgtataattcttgttaaagtttagtcctggtcattagtagtaatttttttctattgtgaagtcatttaaattttattttctagtgaattgtttcttcatatatgaagtcttttgctttttttttt

SEQ ID NO: 33106 - DNA, 335 bp, Homo sapiens
atttcaccagaaagtggggctagagtaggtgtaacagaagcagaaaggcatggagtttgaaaaaagcatgaaatgtatggcaaaagtatgtgaagtgcttggcaaggagtgacaggaatgaagttagaaaagatcttttgtattacaagttgaggagctaaaacttaagctgttaagcagtatagcagtatatagtacctggatgattaaaagcacaagctctggagtcagactgcctgggtttgaatcctagctctactacttaataccttcttgccatggacaagatacttaacatctccaagccttaattttcttatctgtaaagtagagct

SEQ ID NO: 33107 - DNA, 290 bp, Homo sapiens
  misc_feature 231: m=a or c
  misc_feature 232: m=a or c
cattgagttttgatgaacatacactaatccaccccatcaagatacaagaacattctattagcatagaaggttacatctatttccaggcatttcctctcccattccacaataggaaaccagatttctatcaacatagattagttttccttgctcttgaacttgatacaaatggaatcatgcaaatggactcttttgtgtgtggctttcttcactgagcataatgtcaatgammttcatccatgttgttgtgtttatgagtacttcgtagacttttatccctgagtactact

SEQ ID NO: 33108 - DNA, 241 bp, Homo sapiens
taatatctgggagttagggtttccctggagattctaacaaggaggactaaagcatccctgaccttagacccagaggtaatctctatcaaccggggtcctgaattaaactttcttcatcctgttgattgcccttggttttcagcagagtttgcacaaagagaaatcaacacacccaggatagcatgccttagtactccaaacagattctgagaagcataagggtcaaccataaacacacaaa

SEQ ID NO: 33109 - DNA, 271 bp, Homo sapiens
gatttttacttctcttcagtaggtggatccttttctccagatcagtcacattttgttccttaaggccagttatgctctagttttaatctggaatgaacttgtgttcttgtttgagacactcttcctagtgggtgcgtcattatgggagattgtatctatctatataatcttctgtaatttagcatagagaagaaaactgggtgatgagttgccagctaatttatataaatgagatatgggaaaagatctaaccccttcctaaatcccccga

SEQ ID NO: 33110 - DNA, 179 bp, Homo sapiens
catgtctcagagaggaacttatcagagattgagaatgtccatggatttgtttctcattctcatatttcaccaataaaggtaggatagtatctatttattattgttatgaattacatattacttttgttatacatatagctcatgctcggagagaagtattctttcatgtaggttcgccc

SEQ ID NO: 33111 - DNA, 277 bp, Homo sapiens
  misc_feature 236: d=a or g or t
  misc_feature 237: m=a or c
  misc_feature 239: s=g or c
  misc_feature 240: n=a, g, c or t
tggtgacaggggagcctggatgccttgctggagtggatagtctgtggctcgggggagactctctaggagcccccaggccaccctgttccttcctgcaaggttacttgctgccctgacccctctgaggggcaggcagggaggggagaggcactggggaaactgcagggggatgtggttgtgatccaggcctgtggagggagtgctggggaaggggagacttcagcaagggcagatgdmgsnttgttttttccttttttctttctttcttttttttttt

SEQ ID NO: 33112 - DNA, 398 bp, Homo sapiens
  misc_feature 231: b=c or g or t
ctttttctgagtgtctcctacttgcgacaaggtggacttgggaggaaagccgtctgccaaagcctgaagcctccaagttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcabtaaggagttgtcactcttcatcagagtcaccggacctatgcaattacatgggctccatatcaaatggcatggtgtctctactgctgattctcaccttgctggaattatgcgtaaccatctctaccatagcccatgtggtgcaatgcaaactgctgtaattcaagaga

SEQ ID NO: 33113 - DNA, 352 bp, Homo sapiens
actctggagttgctgccttggccctgggatgggaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctt

SEQ ID NO: 33114 - DNA, 366 bp, Homo sapiens
  misc_feature 46: b=c or g or t
  misc_feature 47: y=c or t
ctctgggagccttggtcctgagcagccaacacaccagcccagacabytgcaagtcaccatggacgctgaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttct

SEQ ID NO: 33115 - DNA, 148 bp, Homo sapiens
gaaaactatcttacaatatgccatcgatatctgtgtaccacgtgtgctgcatgtatgagcccatggaggtgaaagtgagatttcatgagccacttattaatacttgtcctctatagaaaccctaaagatagttaaaatagccaacgct

SEQ ID NO: 33116 - DNA, 136 bp, Homo sapiens
aggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccca

SEQ ID NO: 33117 - DNA, 373 bp, Homo sapiens
cattttgaaagccttattttaaaaataagtatgtatctttgtatgatttataagtgtaccagtaggtagaaatacatgtgttcttggccagatgtggtggctcacgcctgtaatcccagcattttgggaggctaaggcgagtggatcacctgaggtcaggagttcgggaccagactggccagcgtggagaaaccctgtctctactaggagtgcagaaatcagccgggcatggtggcgggcgcctgtagtcccagctgcttgggaggctggggcagggagaattgcttgagcccgggaggcacaggttgcggtgagccgggattgcgccattgcactccagcctgggtggctgtataaaagcctgtataaaatt

SEQ ID NO: 33118 - DNA, 365 bp, Homo sapiens
  misc_feature 23: v=a or c or g
acttctagtcttgctgcaaatavctctttcctatatttaaatggagagattgggggagagggttcaatttgtctatttcttagaatgtaaggcagattattttatgtgttcttaatttctgtaagtactcaaaaagtggtgaaaatgaactctttagggctctgatctctttgatacatctattttattatatggtctataaagattcatttaaatattttaacatcttaatcttatttaaaatataattcttatcaatgatagcatgtattactgttacaccttggatcagggagaaccatacaaaccgcactgaggagaagaaaggattctggggcaaatatggtctcatcccaacccattgc

SEQ ID NO: 33119 - DNA, 196 bp, Homo sapiens
tatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgcctgc

SEQ ID NO: 33120 - DNA, 156 bp, Homo sapiens
  misc_feature 96: w=a or t
  misc_feature 98: w=a or t
  misc_feature 144: w=a or t
tttatgtgagattccttcatttcatatactgttatcaatgtgtttgataatggttgaagaaccagttggtgttggtttctaatactaattaataawtwagccttgaagcctgatcaatcttcttatatccattatcagattttwttcttcaaatct

SEQ ID NO: 33121 - DNA, 74 bp, Homo sapiens
  misc_feature 48: s=g or c
aatcctcattgaacgcttctccactttagctgctgcagatgctgtttsaagaagctctgcccctcagctgctct

SEQ ID NO: 33122 - DNA, 316 bp, Homo sapiens
  misc_feature 66: s=g or c
  misc_feature 93: k=g or t
  misc_feature 97: v=a or c or g
  misc_feature 100: s=g or c
  misc_feature 103: k=g or t
  misc_feature 105: m=a or c
  misc_feature 110: v=a or c or g
  misc_feature 134: k=g or t
  misc_feature 141: s=g or c
  misc_feature 150: y=c or t
  misc_feature 250: m=a or c
  misc_feature 265: n=a, g, c or t
cacttccagctgctccctccaaagtttgtcctagtttcccccttcccagctctccccattcgcagsctcttccatcttcaactcttcttccckgctvacstcktmcctcvtccgatggtctctccttggcttckctccacsccgcttgcytcttctctagtctttccctggccctggcattagtctccttaccctgtgccctgtcccaatgtgtgcccgggctttgctccttgcgtgcagttcgaggggmagacatcgtttggcntgtcagtgttcaacctcagcaacgccatcatgggcagcggcatcctggggc

SEQ ID NO: 33123 - DNA, 80 bp, Homo sapiens
  misc_feature 29: w=a or t
  misc_feature 43: w=a or t
agtcgctcggaactgccgacccgagtgcwtcccgcagagggcwggtggtgggagcggagtgggtcgggcgggaggacggc

SEQ ID NO: 33124 - DNA, 340 bp, Homo sapiens
gacatcgagagaaagaatatgaagctagcataggttcacaaagaatgagtcaaatcaaacaacatgcattttttatttataaagcatgacttgttcattgtcaattcatgttagcttaatcattaggcattaatgccatcactgcaatgcatatgtcagcaataaataatcaaagaccaggcttccatcattctgtttaatatcttcaagtaatgcttaagtttgcaaatgctcttttaacacattctccatatgcagcctgcccagcactgcacacaatagacctgttacttccccctcacgagcactcctaatatttcatgtgctcatccaattgact

SEQ ID NO: 33125 - DNA, 299 bp, Homo sapiens
  misc_feature 273: n=a, g, c or t
acactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaatcnaatttaagagtaatacaatgaaaaaa

SEQ ID NO: 33126 - DNA, 105 bp, Homo sapiens
tggggtttcaccatgttgaccaggctggtctcgaactcttgaccttgtgatctgcttgccttggcctcccaaagtgctgggattacagatgtgagccactgttgc

SEQ ID NO: 33127 - DNA, 450 bp, Homo sapiens
  misc_feature 38: r=a or g
  misc_feature 39: y=c or t
  misc_feature 401: m=a or c
  misc_feature 403: r=a or g
atgcccttgtttttttgttttttggtttttgagacggrytcgccctgttgcccaggctggagtgcagtggcgcaatctcggctcactgcaacctccgcctcctgggttcaagcgattctcctgcctcagcctcccaagtagctgggattacagatgcgcgccaccacgcctggcaaattttttgtatctttagtagagacagggttttaccatgttggccaggctagtctcttaactcctgatctcatgatctacccgccttagcctcccaaagtcctgggtttacaggcgtgagccaccgcaccggcccttgagttttgagaggagcaggagtagagggatctcatttcttgacttaccaaacaagaaccagctttctatcttgctagcttctataaggmartaaatgtgagagttaggcatatatttgcactatattaaaagctattt

SEQ ID NO: 33128 - DNA, 452 bp, Homo sapiens
  misc_feature 8: r=a or g
  misc_feature 9: k=g or t
tctacgtrkaggagaattggtggttgaattgcttgaaaccttatgaggaagactggctggagactcccattcttaaatgaacctatgactttctaaagttcaacaaaacataaaaatcagttttgcattggtgcagataatatgtacactgagaggcatggttttttccgtatctagccctccatccaaacgttaaacgtctttctgatttcaggactggcaatggctgacttcagccgtcagggtcccatgagagtctggagagtgatttgaatgtcgcaggcagagcaggaggaagcatggccgcataggaaggtctcaggccatgcttcctctctcatatagggggtcctgttatctttgctccgaacatactattttcatgccatgaagttcttgtacattttatttctacctcttagcagtcagtacagctcttagggtatgcttct

SEQ ID NO: 33129 - DNA, 274 bp, Homo sapiens
tttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggacct

SEQ ID NO: 33130 - DNA, 200 bp, Homo sapiens
tacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcact

SEQ ID NO: 33131 - DNA, 269 bp, Homo sapiens
tgcaatctggacatattcaaagaaatatatgagccctcagatgtgaaggatatcctttccccagcatctctgccagtgggcacacagtctctttttaaatattttgaagatggtgaagggacattacttctcagggcaaccagtgctaatgaagttttgtgttactgttggcctattatgcttccccttactttcctttcagtttgttctgatttttgccttctaaaatagtacagaacaaattttgtcttctttcacctgaccgccct

SEQ ID NO: 33132 - DNA, 413 bp, Homo sapiens
  misc_feature 107: s=g or c
  misc_feature 108: b=c or g or t
  misc_feature 133: s=g or c
  misc_feature 134: n=a, g, c or t
  misc_feature 135: n=a, g, c or t
  misc_feature 136: n=a, g, c or t
  misc_feature 149: r=a or g
  misc_feature 365: n=a, g, c or t
ccgaaaaaatacccagggagtgattccttatgtaccccctccacccctctttataaaatctgatgattacaaaagaaaggaatgggttttttgtgtgcgcacatttsbcccacccaacaccgcctccgcatcsnnngatgggtctcctrcctcagggacaggatctccacacccttgaaggtgaagccctgcatgtctgcaaaaatcttctgcatctgaaacaccaaggatccctgggctcacgtccgaacctgcagacctgaggggacccagacgcccaaccccagctccagggaagacccttcaattcccctccccggccgggtgccgtggctcgcgcctgtaatcccaacactttgggaggnacgaggcaggtggatcacaaagtcagtagttcgagaccagtctggcca

SEQ ID NO: 33133 - DNA, 281 bp, Homo sapiens
gaatggttgtagggactgaaagctgagttggaaggatcagatcaaagagaaagctgggttggcacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggccttccttcttctcccactt

SEQ ID NO: 33134 - DNA, 59 bp, Homo sapiens
ttgattatagagaatgaagcactaatatcccaatataattggagtttaaaaaaaaaaaa

SEQ ID NO: 33135 - DNA, 234 bp, Homo sapiens
caatttttgttttttcctcttcaggttctgatgccagcacatttgaaatccatactgcaagtgaatcctgcaacaaaaataagggtgaccctgcttgccaaacccacagaaacctgtgaagtggatgtgccaagggtccaacccccatattcctcagactcttctattgtcattctttagaactttgttctcattttttcatcactgcactgccaaagtgtagcagcccccaga

SEQ ID NO: 33136 - DNA, 340 bp, Homo sapiens
  misc_feature 94: w=a or t
  misc_feature 249: w=a or t
  misc_feature 267: n=a, g, c or t
  misc_feature 272: r=a or g
  misc_feature 274: r=a or g
ccattagaagatgaaataaacaaagggtctaaaatctcaggcctgcaatactctatacctgacaccgagaaccagacgctgaattacggaaagwcaaaggagatggaaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcwtgctaaacgtgaaccctnatgargrtggagaatcaagttcaagttctcccactgaagaaatgcagccactgacaatattgccttcatgatt

SEQ ID NO: 33137 - DNA, 334 bp, Homo sapiens
caaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagcccca

SEQ ID NO: 33138 - DNA, 274 bp, Homo sapiens
  misc_feature 96: m=a or c
  misc_feature 97: y=c or t
  misc_feature 110: k=g or t
  misc_feature 158: y=c or t
  misc_feature 218: s=g or c
  misc_feature 234: m=a or c
  misc_feature 242: y=c or t
  misc_feature 263: m=a or c
  misc_feature 264: n=a, g, c or t
taactttctgtcttgttgatgtgtctaatgttgacagtggggtgttaaagtctcccattattattgtgttggagtctaagtctctttgtaggtcamyaaggacttgtttkatgaatctgggtgctcctgtattgggtgcatatatatttaggatagtyagctcttcttgttgaattaatcgctttaccattatgtaatggccttctttgtctcttttsatctttgttggtttamagtctgtyttatcagagactaggattgcmngccctgccta

SEQ ID NO: 33139 - DNA, 94 bp, Homo sapiens
tttctgttttacggtgtttaggatctgtctcctgtcttttctgttttcccatatctcccttttggatacatagctcactactttatggcttgtg

SEQ ID NO: 33140 - DNA, 227 bp, Homo sapiens
ttaatgattctcaaaattatctgaggggtaatttgaaaatacacatattggagtcctgactttcaagacccgattcattttggattagagtccaggtgaccactttgaaaagctcctctgaactctgatgaacagctataattgacagttactacttctaaaccagtactgtcaaatagaaatataatacaagctacatgctatttaaaattttctattggccacat

SEQ ID NO: 33141 - DNA, 135 bp, Homo sapiens
tagtgacactgttcttactctaaatatttgcagccactcttttgggactacctttaaggccaatagtatatgtattattaaacacatcctgagcctttggaaggtaaatttggttttcttttctttttttttttt

SEQ ID NO: 33142 - DNA, 247 bp, Homo sapiens
cagcagattcagcttagagaaacggtgctcacagtgctggggtaggcagcagagaaggctaaatgaaggactccggagagctgcaggtggatctggaccaaatccagaacccaacgccttactccctcctggggagagagctgggcagagacttggggcgggcagtgaggtggggataggtgagcagcactcgtggtgagtggccccagtgtgatttaggaggggtgcagtgtgggatcccagggca

SEQ ID NO: 33143 - DNA, 51 bp, Homo sapiens
  misc_feature 44: y=c or t
gcagcggggcaccggaagttatggaggtattaataggggacccyattacca

SEQ ID NO: 33144 - DNA, 142 bp, Homo sapiens
  misc_feature 88: s=g or c
  misc_feature 98: k=g or t
  misc_feature 103: r=a or g
  misc_feature 112: w=a or t
  misc_feature 114: k=g or t
  misc_feature 116: r=a or g
  misc_feature 119: k=g or t
  misc_feature 131: k=g or t
cataggttaaagatctcttttgaggccatacaattgatacataaaaccaaagctcagatccacatctgtgtaactctgtaagttttgscctttccatkatacrtttggtccwtkaraakatttaataattkataagctctat

SEQ ID NO: 33145 - DNA, 297 bp, Homo sapiens
  misc_feature 93: k=g or t
  misc_feature 96: k=g or t
  misc_feature 103: y=c or t
  misc_feature 104: w=a or t
  misc_feature 105: r=a or g
aggaataatgtgaattacttacacattttattggcctatgataaaagacaagctaaatctcaccatttgagtagtatatttaattctgatttkcckattgtcywrgccttagaaacagtatccctggatggtagatcctgttgggatgttgtatttgaaagagatatttttggatgtgacagttataaaggtagttcagtgaacattgttcacctaggtgtattctgttttttgttactattcttggtggtaaagtccatcagagttgagattttggtaacagttttatggggatga

SEQ ID NO: 33146 - DNA, 209 bp, Homo sapiens
  misc_feature 103: r=a or g
  misc_feature 113: k=g or t
  misc_feature 115: s=g or c
  misc_feature 117: r=a or g
tagtgagacaccgtctctataaaaaatttaaaaattacccaggcgtggtggtgtacctatagtcctagctactcaggaggttgagatgggaggattgcttgargcctgggagktsarggctgcagtaagcatgattgtgccactgcactacagcctgggtgacagagtgagaccattatctcacacacacacacacacacacacactgt

SEQ ID NO: 33147 - DNA, 258 bp, Homo sapiens
  misc_feature 141: r=a or g
gaatgtaaaactcgcagcagatatcagtgggaagggctgggggagggggcacccagctgcctttcctccctcacaggagccaccaccagccacctctcaggagaagccagaggccctggccaaagataggaggaagaaagrgaactctccatagaatgtaatttatagatgcgtgtatatgtatatatatctatttatatgtaaataggcatatatgaagatatatatatatagtctactttttaaactctgcagggg

SEQ ID NO: 33148 - DNA, 173 bp, Homo sapiens
tgattattttatcacgcatcagagccttcgtgctttgattatcttgtatgttaacaattctagaaaacattcatgaattcacaaaaatatgttactatggcaggggaacattttgtacacatttaagtatataaaaatactaaaatatgtaattttataacaaagtcacggga

SEQ ID NO: 33149 - DNA, 240 bp, Homo sapiens
gaggaaaagtgagatgataaaagagtctgcctgaactctaacgttttatgttaagttgttttcatgcttggctttacctgccctatcccctttctgggcttcagtttctctatgtgtacagtgagatgttgaactgaatggtcttgctgctcttccttccttcattaacatgagaacagatagttgatgcctctgatgttcatgttgttcccattgcccttttctctttaagcgcactca

SEQ ID NO: 33150 - DNA, 139 bp, Homo sapiens
agaagtttatgcgtgcttccggtccgcgagccctgagagctaacttggggtcttttcccaaggtggatgtagaagcgggctccggcgtcccactctcccttccatatgggcttagcgtctgggtcactgagaacgacta

SEQ ID NO: 33151 - DNA, 217 bp, Homo sapiens
ctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcaata

SEQ ID NO: 33152 - DNA, 347 bp, Homo sapiens
cctgacctcaggtgatccacccaccttggcctcccaaagtgctgggattacaggtgtgatcccacagtggtgcccggccagttcttcatttttaaaactatttttttttctcttgttccttgtgttttgggtgtcatacctatgaaatcattgcttagtccaaggtcaagagatttatccctatgttttcttttaagagtattatagttttagattttgtatttaggtctgtcaaccatttcgggttaacttttgtgtagtatgaggtaaggtacaacttcattcttttgcaggtaatatgtttgtgccagcaccatttgttaaagacagtgttctctctccactgt

SEQ ID NO: 33153 - DNA, 345 bp, Homo sapiens
  misc_feature 116: k=g or t
  misc_feature 322: b=c or g or t
  misc_feature 323: n=a, g, c or t
  misc_feature 324: n=a, g, c or t
ttatgtttaaaaggtcacaagtctagaataactgaattgggaattggaaataccttaattctataatttgtatctaaaattaggttttcccttttaagttgttaattttctatggkttgtgctgcatgctttcacttttattagtacttacagccaaagagatgggcaaatgtctagaaaaattaatgttttgattcaggaatttgtgcctagtgatggcctccaatagagaattttccagagagaatgaagactcagtttctaagttggggcaaatttagtttttgttttggtattcttcttatattacagctattaaaabnntctcttaaaaaatgccggcac

SEQ ID NO: 33154 - DNA, 397 bp, Homo sapiens
gtttggctaagggttgttggtgaaatcctaggcccagtgaagctgcggtcagctaggagcttggtgctcattcctctttcacgtggcagaaggtgggcctgggtaggtaaggggccttcatggccctggacttgaccatcttgtgtggcagtgagggactgatcctcaccaggactaagaggagcctgagcccctcttggtaatagcagtaatgtggctatgtaaggtatgctgctcagtcattaaagagagggccataacctccccttcttgggccctttatgcttgttgttttaattttcacttttaaatttagatgaaatgattttgctttttgttagaaccagcctgtctagcagagtgcttcaaagaaagatttttttcatgcatgtgtgta

SEQ ID NO: 33155 - DNA, 303 bp, Homo sapiens
  misc_feature 106: b=c or g or t
  misc_feature 107: s=g or c
  misc_feature 126: y=c or t
  misc_feature 128: n=a, g, c or t
  misc_feature 129: v=a or c or g
aggcgggccatggcggatgtccccggggcacagcgagcggttcctggtgacggcccagagacccgggaccccctggactgttgggcctgcgctgttcttgtaacabsccagaatctgctggtggcygnvttcaatcttctcctgctggtgctggtgctagggaccatcttgctacccgctgtcaccatgctgggcttcggcttcctctgccactcttaggacttgaagcccggcatcttccgacctgccctgcccccacccctgcctgagcggagtcctagcatccccttgggagcagcagca

SEQ ID NO: 33156 - DNA, 73 bp, Homo sapiens
aagatcaggccaaaatctcagcattctccatggctcccagtgcttctcggcagtttttttttttttttttttt

SEQ ID NO: 33157 - DNA, 136 bp, Homo sapiens
gagagactcagcccctgcccctcagcggataacctgggactgaccgttccctggggatccgacgggccccagaggacccacgcctgagccccgtgcgactcgtggcctttgggctagaagccatggacgccttcct

SEQ ID NO: 33158 - DNA, 272 bp, Homo sapiens
caaaaatcagtctgaattccagggcctacactcaacttgcttttcttaggagctaataccttaactgttgcttctgttccaaatgaaagcttcatgcaaccatgagtgcagaggctgggcatgaaggagggtctgtaggaaactggaattgctgttctgtggggagccaggcatccatgcagaggcagaaactccagaaccatttagctttaaccactcccattcttgttattagtactctggtcacactgtgatgccatgatgacccacca

SEQ ID NO: 33159 - DNA, 186 bp, Homo sapiens
  misc_feature 91: k=g or t
  misc_feature 103: k=g or t
ccggaccctgtagattgggcgccaccaccagatccccctcccaggccttcctccctctcccatcagcagcctgtaacaagtgccttgtgakaaaaagctggakaagtgagggcagccaggttattctctggaggttggtggatgaaggggtacccctaggagatgtgaagtgtgggtttggttaag

SEQ ID NO: 33160 - DNA, 55 bp, Homo sapiens
cctgcaaaatgtatactcgggttgtttttctttttaaaaatattgtaaaacaggc

SEQ ID NO: 33161 - DNA, 169 bp, Homo sapiens
  misc_feature 96: k=g or t
  misc_feature 117: k=g or t
tgtatgcaaatacctgctactaggtactcttagtcaccctaatagattcttcctgtgattcccctcttttaaaatttttatttccataggctattkggggaacagatgttgtttgtktacatgattaaattctttagtggtaatttgtgagattctggtgcacccatac

SEQ ID NO: 33162 - DNA, 232 bp, Homo sapiens
  misc_feature 98: w=a or t
  misc_feature 100: k=g or t
  misc_feature 106: k=g or t
  misc_feature 108: b=c or g or t
  misc_feature 128: n=a, g, c or t
  misc_feature 129: n=a, g, c or t
  misc_feature 130: s=g or c
ctgttctgcacccgcgtttatttttgtctcttgaaaagatcaccatccatggccctataaatgtcttaggaaatggaatgatgaagtgcaatggtcawtkattgtkabgtatttctcatcgttttacnnstgagaaaactaatttcatggtattctgaagactagagatgattcaacaagtgacagaagctgcagacttaactgaggcctctctgtctctcttttttttttt

SEQ ID NO: 33163 - DNA, 117 bp, Homo sapiens
  misc_feature 89: r=a or g
  misc_feature 93: w=a or t
ctctagaaagatgaacaaaggttaatttaaacttacctaagaagatgagaatcaaacaaaacagatatgcttactctagttaaaaagaraatwaattctcatgtcagacccagaaat

SEQ ID NO: 33164 - DNA, 136 bp, Homo sapiens
caaaaaattagtggggcgtggtctcaggctcctgcagtcccagctacttgggaggctgaggcaggagaatggtgtgaacctgtgaggtggagcttgcagtgagccaagatcgcgccattgcactccaacctggaca

SEQ ID NO: 33165 - DNA, 209 bp, Homo sapiens
cataaccattagtagttactccccatttcacactctcccaccctattctttccccttccctgccaccctcatctccaggaggcaatcacttacctactttctgtctttctgtatttgcctattctagacaatttattattccttctatctaactgtaagtatatgtcctttgaccaacatctcccccatccttctctttcccctaactc

SEQ ID NO: 33166 - DNA, 267 bp, Homo sapiens
actcgccaaggattcgacatcggggttgttggtttaacttcccttttccccagaggcgcttcgctgtcaggccccaggattcgcaccggctccgggtcctgcctaaactcggcgatggggaagcatcgtccccagcgccgggaccaggagaagggggccgccaggcagggaggacagcggttcccgaggaaggtttcggagagtgaaagagaccggaggggaggcggctgatgtccacgcccgagccaagactctcaaatcccactt

SEQ ID NO: 33167 - DNA, 183 bp, Homo sapiens
tacaaaatgatgatgtcacctatattcattgagaattatttgactaccacatttttcccctgatggatagtcatctatcataacttgtgtttgttttcctcctgagatcaaacacttggtgcttattcctgatgtatactctgagaccagctcttaccttctgagtggcagctacccctcccc

SEQ ID NO: 33168 - DNA, 331 bp, Homo sapiens
  misc_feature 208: k=g or t
  misc_feature 217: k=g or t
  misc_feature 234: r=a or g
  misc_feature 254: w=a or t
  misc_feature 255: r=a or g
  misc_feature 276: s=g or c
  misc_feature 286: r=a or g
ttatattactttctaagcccagttaacctcagttctgggccacatgactggggtctctagtcatttagtacagcaatgccacttccattcttcaaaaacccctcagtggtcagctaggcacgatggctctctcttgtaatcccagtacttttggaggctgaggtgggaggatcactgtaggccgggagttcgagaccagcctgggaakcatggcgakaccgcccctctacaaaraataattggctgggtgtggwrgcgtgtgtcggtggtcctagstacctgggargcaggacgatgatttgatttcaggagttcaaggctgcagtgagct

SEQ ID NO: 33169 - DNA, 71 bp, Homo sapiens
  misc_feature 20: w=a or t
  misc_feature 34: k=g or t
gtggaggggcgcacgccggwagcggcgagggtakccatgacggcctccgtgctgcgaagtatctcgctagc

SEQ ID NO: 33170 - DNA, 196 bp, Homo sapiens
taactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcg

SEQ ID NO: 33171 - DNA, 169 bp, Homo sapiens
  misc_feature 33: m=a or c
  misc_feature 129: m=a or c
  misc_feature 142: m=a or c
  misc_feature 146: m=a or c
catctaaaagagtcaacatgattatttctaggmagaggcaactggttgtagaggaggagggaaaatgggggactgctctttttcctaacaaaacttgtagaaccaattgactagaagcatattcaagamaaatatcaatgamaggmgggaaaaatgatacagtgggcaa

SEQ ID NO: 33172 - DNA, 61 bp, Homo sapiens
caatactggaacaaatattgtgggcatgttgaactataaacaaagcaaagatagctctttt

SEQ ID NO: 33173 - DNA, 207 bp, Homo sapiens
aggataaaggattttttaaaatttaattttatttacttattcatatatttactttaagaactttcgttttaggttcagaggtacatgtgcaggtttgttatatgggtaaactgcatgccacttggtttacgaattattttgccacccaggtaatacacatcatacctgacacgtagatttcccatcctcatcctcctcccaccctcc

SEQ ID NO: 33174 - DNA, 152 bp, Homo sapiens
catatttacttgttagcaagatcgttctgactgctagcagactggatgaggaaagtgtaggcacgcagcacagggcagtagtcggttggagtaaacctgaagagacatgatgagcttctgttaggcagtggcaggagggatgggggggagaa

SEQ ID NO: 33175 - DNA, 226 bp, Homo sapiens
gcggcagtagctctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccaaccgc

SEQ ID NO: 33176 - DNA, 299 bp, Homo sapiens
tttggatctatgatcagcctttcactgaattaaacaatttatatgtgagaggggatagtagtcgcttcttagtctggctcagcgaatctgcatttttatataaacagtggggcagaggaagcaatcagatatgcatttgccttagatgagcagacagatgactttgagttctcttctttgttccgcatctgtgaagataagccatcactttacatcaccaaagtgaaattcagcagaattgttttagggtaaagatcttgaggagtttccttgtgggcatattgtgagggaggtatgta

SEQ ID NO: 33177 - DNA, 130 bp, Homo sapiens
ccgtcttgtaagatgagttaggctgccccttggaccagccacaaaatggaatatcaagtcttatgtacatacgtgaagagttaccaccagtcctgccacctttggatagctctaacaccatccccagcta

SEQ ID NO: 33178 - DNA, 326 bp, Homo sapiens
  misc_feature 36: m=a or c
  misc_feature 47: m=a or c
  misc_feature 53: y=c or t
  misc_feature 60: m=a or c
  misc_feature 99: m=a or c
  misc_feature 103: m=a or c
  misc_feature 218: m=a or c
  misc_feature 237: m=a or c
aactatcaatgatattcttcacagaactggaaagamaaactattttmaaattyatatggmatcaaaaaagagcctacatagccaaggcaattgtatgcmaaamgaacaaagctggaagcatcacgtcaaactatactacagggctacagtaaccacagccacctggtactggtacaaagagacacacagaccaatgacacaggataaagagcccagamataagcctgcacgcctatmaccatctgatcttcgacaaaactgacaaaaaccagcaatggggaaaggactccttattcaataaatggtgctgggataactcgctagcc

SEQ ID NO: 33179 - DNA, 452 bp, Homo sapiens
  misc_feature 105: w=a or t
  misc_feature 388: w=a or t
  misc_feature 394: y=c or t
  misc_feature 434: m=a or c
catttagaattgtgtacaggtcaaatcccgttacaacaatttcagaagagtatctaacttatttgtcttaaagcttatactgcaaagtattaatatgtaatatawcagattatagaacttttttgttcttaagtttctttggagaaaaaaacacaaggacttttgaaggggcatttctaattaaccccacagccagcttccttgttaccaagaccctggatgggaatttgctatcactggttggctgcgtggcaccaggcagctcgttgggctcacttgcctcgtgctataccactccggagtgttcatttattcatgcagcctaaaaagtgtagtgggcatcgagatttgcttggtgctctgggagaagactaacatcaataaaagwcgcagycctattcattaggaatttacagactgcttggaagaggcgmccgcaaagcagagtctaa

SEQ ID NO: 33180 - DNA, 77 bp, Homo sapiens
tcttcagagaatgaaagtaatgagaaaattaagtttctagatgaatgttgctccaagtatttgaaattattcagagt

SEQ ID NO: 33181 - DNA, 306 bp, Homo sapiens
  misc_feature 106: r=a or g
  misc_feature 155: r=a or g
  misc_feature 257: y=c or t
attgtttggttaaaaaaatacataatttaggctgagtgtggtggctcacacctgtaatcccagcactttgggagtccaaagtggaaggattgcttgagcccgggartttgggaccagcctggacaacatagtgagactccatttctctaaaaaaraatttaaaaattggctgggtgtggtggcgcatgcctgtggttcctattactctggtggagactagagcaggaggatggctggagctcagaagttcgagtctycagtgagctgtgttcataccactgcactccagcctggatggcagagcaa

SEQ ID NO: 33182 - DNA, 113 bp, Homo sapiens
  misc_feature 90: r=a or g
  misc_feature 94: k=g or t
  misc_feature 95: k=g or t
  misc_feature 97: k=g or t
ttttgctactagttggtaagtttttttgttgttgttaaagctaataatgaagcttataatgtaataatataaatgtttagtaatagctaractkktkgcttgtgtgggtcaaa

SEQ ID NO: 33183 - DNA, 263 bp, Homo sapiens
  misc_feature 91: r=a or g
catattattgtatatagtacaagatgaagttttaaaaagtgagtcaattaaaaaattaagaaagcggtacaaatcagacagaaatcatgaracagcacttccatgacttaaggtgggaaccacagaacgggtattaagcaaggcccccgaggccaagaggactggatttggattccagctccaccactttgctgactgtgtgatctcagggaagtcatggagccagtctgagctcggctggttgaacgtaaaatggagaggga

SEQ ID NO: 33184 - DNA, 259 bp, Homo sapiens
  misc_feature 88: s=g or c
ttgtttgtttgtttggttttgcagggatgggttcccactatgttgtccaggctggtctcaaactccaagactcaaatgatcctcctgscttggcctcgcaaagtgcttggattacaggtgtaagccaccacacctggcccttctcctctccattccaacagtgaaaatcgtggctcccatcatttcccagccatttacttatgtggtcagttccagtacatatgtggagcattatcagggttttgataacctggacccc

SEQ ID NO: 33185 - DNA, 71 bp, Homo sapiens
tgacatgcatagggtgtgtaatgatcaactcagggcatttatcatttccatatgtatttatcatttctata

SEQ ID NO: 33186 - DNA, 211 bp, Homo sapiens
  misc_feature 95: k=g or t
tatggcaagagatagagatctagtttcattcttctgcatatggatatccaattttcccagcaccatttattgaagagacagtccttttgccagtktatgttcttggcaactttgttgaaaatgcatttactgtagatgtatggattcattattgggttatctattctgttccattgttctgtgtgtctgtttttatgccagtaccatgcct

SEQ ID NO: 33187 - DNA, 323 bp, Homo sapiens
  misc_feature 90: k=g or t
  misc_feature 115: r=a or g
  misc_feature 205: r=a or g
caaaaaataaactggccatggttttgcaaggtgggcaaagccaggaagaggagatcgggagagagaggtccgatgtgaagatgtgcacakagatgtctggaaaataagcccagaraaaatagtcttcataacccatataggggaaagtggaaaaaaacttgggcagagttctaacgtggtgtgtcatcacaagacacatgccagrgagaagccctaccagtgtaaagaatgtaggccaggcgcagtggcatcccagcactttgggaggtcaaggcaggtggatcacgaggtcaggagatcgaaaccaccctggctaacacggt

SEQ ID NO: 33188 - DNA, 111 bp, Homo sapiens
catttttgatttcatattttttctttaacactatgatactttaaaaattattggctgggcttggtggctcacgcctgtaatcccagcactttgggaggccaagacaggcgg

SEQ ID NO: 33189 - DNA, 79 bp, Homo sapiens
  misc_feature 9: k=g or t
  misc_feature 60: k=g or t
  misc_feature 61: k=g or t
tggaatttktttctcttttctgtctctacttcagctgtttcctacatattatatattttkkcagctgtttcctatacat

SEQ ID NO: 33190 - DNA, 73 bp, Homo sapiens
  misc_feature 2: k=g or t
  misc_feature 3: k=g or t
  misc_feature 7: s=g or c
  misc_feature 19: s=g or c
  misc_feature 26: r=a or g
gkktccstgttcctcaggsgtctgcraccctcctgggttgcggcgtctgctcgcccttctgcgtccgcagctc

SEQ ID NO: 33191 - DNA, 256 bp, Homo sapiens
agttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccac

SEQ ID NO: 33192 - DNA, 172 bp, Homo sapiens
  misc_feature 81: r=a or g
cagggagagtgaattaatgaataaatacatgaataaaatttagcgcgatttttagaaggataataggatagttttgtccaraaacccttcagatccacggttcagtctgagccatccagccatagcaataaagtaaaaattaccacatggtacaaatgtgtcaccgtcaagc

SEQ ID NO: 33193 - DNA, 176 bp, Homo sapiens
caattctctttaagaacagagtaatcttgcatttaacttagaagtatgttaaaagcttaacatacttctgatgcttaaaccaaatcttacaaaagcactgtaaataaaggattttgttgtgttttgttatttaatgaaagggagttgccgactctccccatagatgtcaagcgcac

SEQ ID NO: 33194 - DNA, 116 bp, Homo sapiens
aacttagccattttgatatttgttaccaaagcctgcttaacccataaagttttctggttcctcttgttctctgtagtgatgtttctagatagatgcccactgatatatgcccccca

SEQ ID NO: 33195 - DNA, 283 bp, Homo sapiens
  misc_feature 57: k=g or t
  misc_feature 79: k=g or t
  misc_feature 112: k=g or t
attgctgggctcgaagcacaggagagaccagtccttccttgtctccactgggctgtktagtgcttctttcccaaggacktccatcccttccccaggctttatggttccagtkcttctaccattctggaagctccctagaatctcctggaatgcttaatggacctttccagcaccgaaattcaagaattatgactcatcggtcagcagaaaagaccctgctgggatctttgagcttgtggaggtggtcggcaatggaacctacggacaggtgtacaagggtagg

SEQ ID NO: 33196 - DNA, 132 bp, Homo sapiens
  misc_feature 93: k=g or t
cgtggctaatattacttgaaaacatgcaagatcctttataaagtgttggtgtgaattctgtaaggtcacatttaattaagttgtttatttttkacttatttttattaaaggcaaagggaaacagttggaaga

SEQ ID NO: 33197 - DNA, 241 bp, Homo sapiens
catttgtgatccatcctcatcctattgccaatgaggctggagagaatataaggccctaaattagtgtaggaaacaaagtccactttctggctgacacttcaagtacaaggcaagcaaacaaagcaaagcatggtggtggtgaggggttgggggttggggctaagaagttcaaagtcacacctgagactcagagcccatctgatgctctcatgctgtaaagctgcggtccaaatacagggca

SEQ ID NO: 33198 - DNA, 324 bp, Homo sapiens
ctccaggagccgggaccaaaataaccgggcgggaggggacacctcgcagagatggatctcgaactcctgggctcaagcgatcctttcaccttggcctctcaagtagctgggaccacatttgctcaccagctggcccaagaccagactgggcaacatgggtcatcctcctctaagattccaggaccatgatcatccctctattgctacttcttagatcagcttgtaatgtccatctcccccaccagactgcgtctccagcatctctgagtccccagggcctggcctggggcttgctacatggtgggtgctcagtaactgtgagat

SEQ ID NO: 33199 - DNA, 219 bp, Homo sapiens
  misc_feature 105: r=a or g
  misc_feature 107: s=g or c
  misc_feature 114: s=g or c
  misc_feature 119: s=g or c
  misc_feature 121: s=g or c
accccgtgcctagggcagcacaaaagccaatcgctagcaaactccctgcctagcaaggcccagcctggggcagaaatggctgcaagtggccgaggtctctgcaargsttgtggsccgcststcccttcccggcgtggagacgagataacacggaagccaggggaggtctgaagcctgagtatgatgcggtggtgataggagcaggacacaacggacccc

SEQ ID NO: 33200 - DNA, 334 bp, Homo sapiens
  misc_feature 261: r=a or g
ttatcttctgtctgtattttcagtagagcttagctgtgtatgtgtacatgtgcagaaacaccatctgtaagcatattttcattgattcatatttgaataataaatactgtgcaatatttgatctttggccagcagtgtcagaaatatcaagaatcgtgtggaacatgacataattcttagtcattttttcataaaattcttgaaattatattttagtggtcctgacttagcatgcctaataaatccctttgcattgtaagrcagatacacacctgagacactgaagttagactttcagaattgcttttattatttccttgaaatgaatccccca

SEQ ID NO: 33201 - DNA, 157 bp, Homo sapiens
  misc_feature 108: w=a or t
  misc_feature 111: k=g or t
ttttatagctatcacaaatgagattgctttcttaattttttttcagattaatcatagttaacaaatagaaactattgatttttgtatgttgatttcgtatcttgcaawttkacctaaaatgggttagcaattctaagagttttttggtgaaggcatc

SEQ ID NO: 33202 - DNA, 159 bp, Homo sapiens
agagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagaccc

SEQ ID NO: 33203 - DNA, 173 bp, Homo sapiens
catgttatatttcacataattcaatatgtagataaaataacaaagatgggaaataaaaaacaaaatgggttacaaacaaaagatgaaacccagtgctattaacagctgtacaattcttgatgtgttcaacgtattgatttcattcttctttctgaatgtttgttcctggaacc

SEQ ID NO: 33204 - DNA, 325 bp, Homo sapiens
tacaggcgtgagccactgcacccggcccaaatatttaacattgactgtatgccagggactctgctgggcactgagagtgcagcaatgaggaagagcagggcccattctcaggaagctcaggggtgggaatgggaggaggaatcagaagcaagccaacagggacagtgtggggtgggggtcagctcagcacactgtaggagtcccaaaaagtgaggagacctctaagctgagtcctacaggagaagcaagaatagaagcagggcaaagatgggggtcggcccatcattcctagacgaaaggcagagtttgagaagtgggggccagc

SEQ ID NO: 33205 - DNA, 169 bp, Homo sapiens
tacgcatatatttccttaaatttgtatttagataggaaaacagttgttaatagtgattaaatatcactcatcgtcacctatgagtaatgtttaatagcaaggaaaatctaatttacagtcaacatttattgaatgctttctttatgtaagccttgtatctgagattttt

SEQ ID NO: 33206 - DNA, 218 bp, Homo sapiens
  misc_feature 71: k=g or t
  misc_feature 72: k=g or t
  misc_feature 86: s=g or c
  misc_feature 87: s=g or c
  misc_feature 96: k=g or t
  misc_feature 101: k=g or t
  misc_feature 120: k=g or t
  misc_feature 184: k=g or t
acagaatataaaggagactgttgaattcataccatataaaacttgttaggtttttaaacatagcaatcaakkctacaaaaacaaasstgtgttgtktttgkatagattgtgaggtttatktttggatttcatatacattactgaactgtgtgcaaggcaatagttagccttgattttagcccakagacagatggcagagctatctctctcatagcttt

SEQ ID NO: 33207 - DNA, 153 bp, Homo sapiens
tatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgc

SEQ ID NO: 33208 - DNA, 267 bp, Homo sapiens
  misc_feature 14: y=c or t
  misc_feature 82: m=a or c
  misc_feature 93: m=a or c
  misc_feature 160: m=a or c
  misc_feature 237: m=a or c
tataggtaattttyactttgtctcattttcacatttctcccatgtttcgctactatttttatttattatttttataatttamaataatcgggmtttttggggggcagagaaaaggtcttgctctgtcacccaggctggagtacagtggcatgatcatagmtcactgcagccttgaactccttgtctcgagtgatcctcccacctcagcttcctaaaggcgtacgcacaacaccctgmcaacaatagctattttaaaaagtattttaa

SEQ ID NO: 33209 - DNA, 58 bp, Homo sapiens
caattttttagtggttgctctaggggttacaatggatgaacttttctttttttttttt

SEQ ID NO: 33210 - DNA, 265 bp, Homo sapiens
tatttatttatttatttatttgagacggagtcttgctctgtcgcccaggctggagtgcagtggcgcgatctcggctcactgtaagctccacctcccgggttcatgccattctcctgcctcagcctcccgagtagctgggactacaggcgcccaccaccatgcccagctaattttttgtatttttagtagagacggggtttcaccatgttagccaggatggtctcgatctcctgacctcgtgatccgcccgcctcggcctcccaat

SEQ ID NO: 33211 - DNA, 102 bp, Homo sapiens
cagtgtaatagtgttttaccaccaactgcctttctttgttcctagttactgtaacaaatatttgatgatagaggtttattaattttgtttatccagaccacc

SEQ ID NO: 33212 - DNA, 214 bp, Homo sapiens
catcagggaattcatactaataaataataaaaattaaagcccctgtcaccttcctcatattttaaaccaaaaatcatgtctaatagttaccctcttccgtagttttttttaaaactttgtatttaaattttgtatccaaatgtatttcattccaggttataaattcggagtctaaagtgacattccctctctcccccagtcatataccgatgcc

SEQ ID NO: 33213 - DNA, 170 bp, Homo sapiens
tcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcagacca

SEQ ID NO: 33214 - DNA, 167 bp, Homo sapiens
  misc_feature 19: s=g or c
  misc_feature 38: r=a or g
  misc_feature 39: k=g or t
attagccgccgcgctgagsagtaggaggtagaaacgcrkttaaaaggcgctggggcgggagccgaggctcccgacccgcttctgttttcgttttctccacccttccccttagacgccgataagggacaggtcgtactgcttttgtgcgccgtttcctctcactcccc

SEQ ID NO: 33215 - DNA, 313 bp, Homo sapiens
  misc_feature 300: s=g or c
attatatatagtgtatatatatatatacacatatgaagacagagtctcactctgtcgctcaggctggagtgcagtggcatgatctcagctcactgcagcctctgcctcccaggttcaagcaatcctcctgcctcagcctcctgagtagctgagactacaggcgtgcaccaccacggcctggcaattttttgtatttttagtagagatttcaccatgttggccatgctggtctcgaactcctgacctcaagtaatctgcccacctcaggcttccaaagtgctgggattacaggcgtgagcsaccacacccctcc

SEQ ID NO: 33216 - DNA, 168 bp, Homo sapiens
  misc_feature 118: y=c or t
  misc_feature 119: y=c or t
  misc_feature 155: m=a or c
cagacatgtcagtacacagagtcaatggcagagacagagccagtgggcagttgcaccatgtggataaggacttgagtgagacctgtctccaaagcaggggatcactcttctaattttyyatatggtgtttttcattctattctgactcatttgtmataaaacctccac

SEQ ID NO: 33217 - DNA, 148 bp, Homo sapiens
aaatgtgtctttttctttgggctactgtaccctgcttccagtgctgtccccggcataggtccatctctgcagaagccatttcaggagtacctggaggctcaacggcagaagcttcaccacaaaagcgaaatgggcacaccacaggtaa

SEQ ID NO: 33218 - DNA, 98 bp, Homo sapiens
  misc_feature 12: w=a or t
  misc_feature 76: m=a or c
aagctcgctgtwtcctgctatggcttgtgtgactgagtatgcagtaaccgggggtggatgtcgacacgagttccamgcgttaggagtaaacactgcga

SEQ ID NO: 33219 - DNA, 240 bp, Homo sapiens
catcatcttgttaaaatgtaaatcggatccaggcttgcccctgcattaaactcaccagtgacttcccatcaccctcagaatgaaatcccagcccggggccccatgcagccttgcttctcgccagcctcagcccctccagccctgggtctctgtagttgcaaggcttgggatttcgtccccttagatccttgcaggagtacgggggaggggggcccttcttgtcactcagctctcatccca

SEQ ID NO: 33220 - DNA, 388 bp, Homo sapiens
  misc_feature 373: n=a, g, c or t
  misc_feature 374: k=g or t
tatgcccattttgtgtttaagcaaaagaatacttatcaaatgctgatctccacacatagtatagagcatagtgtttaagagtgcggacattggaacttgactgcttgagtgggaatatacattccaacatgtttttactacatgatctgaccactttccttcagtttccacatattcaaaatgggaaagtacccattccagatgtaggttttgagaaatattgagttacagtgcttaaatgagtgcctggcacactaataaaatttgtccattttagttattattgttaatgaaattgccagtgtttgcagaatatctaatctcatgctgttatctcttaaaatctctaactacattatcttttactttaaankaaaaccaccagaga

SEQ ID NO: 33221 - DNA, 246 bp, Homo sapiens
cactgcaaaatgataaacatgatatcaatcattacatgggaaggcactatataaagaataataccttaggttaaggccacataaatatttatcaggtgccttttctgcggaggactctgaagggatactaaactgcatttagctgcatgcaactgaaactacttttacctacattgtctcttataaacattataactactctttgagaaagtgtttactatggactgaattgtctccccatcccca

SEQ ID NO: 33222 - DNA, 200 bp, Homo sapiens
catgtctaaatttctttcatcaatgttttatggtttttaagtgtacacatctctcaccttcttggttaaatttattcctaagtttttgtttttctttgatgctatagtaaatgagattattttcttgattgcttcgtcagctaggttatttgtatacagaaatgcaactgatttttatatgttgagtttataccttgcta

SEQ ID NO: 33223 - DNA, 298 bp, Homo sapiens
  misc_feature 286: m=a or c
  misc_feature 287: w=a or t
catttaggaaatgggtgcacagagaagctgattcattttcccaaggctgcattgctttacagagctgagatttgaatccaagtttgtccaccgggtgccttcgtagcctttggggcctaagccaggccttgaggggtggacagggtcaaactggtccttccgcagcactaggggcatcaggaatgaaggcctggagattacagttggtttgtctttcctggatgagacaggaaactggcttaattagagcaggagtttgtgtgagagggcaatgggaaatacaggmwgtaggtggggc

SEQ ID NO: 33224 - DNA, 195 bp, Homo sapiens
  misc_feature 87: s=g or c
  misc_feature 102: s=g or c
ttcgtgtttgtttgtttgagaaggagtctcactctgttgcccaggctggagtgcagtggcacgatcctggctcactgcaacctctgsttcccaggttcaagsgattcttgtgcctcagcctcccgagtagctgggattacatgcatgtaccaccatgcctagctaatttttatatttttagttgagacggggttc

SEQ ID NO: 33225 - DNA, 274 bp, Homo sapiens
tgtgaatgttgaaactgtcctgcagtgattccacttctcaaagcaccaccccagggccacattcacttgggactggattcgatacaatttcaaaacggggagtcgggaattccttaggaccctctgtggacaaaaagctgatacccttgttaccacaaggattcctgcacttcttctagtttgtagctttccaggagacctggcagaaacaacaaatcaaatctccatgcttaacaatcctttacctttgaagactttaaaaacaaatgaggcg

SEQ ID NO: 33226 - DNA, 267 bp, Homo sapiens
gaccccgtctctacaaaagaaaaattagctgggcatgtggcacctgcctgtggtcccagctactcgggaggctgtgaggcaggagaattgcttgggcctgggaggttgaggctgcagtgagccgcgatcacaccactgcatgccagcctgggcgacagagtgagaccctgtctcagaaaagaaaaaaaaagtaaaaattgcatgtaagttgacccgcactattcaaatttgtggtgttcaaggttcaactgtaatttcctagcaact

SEQ ID NO: 33227 - DNA, 57 bp, Homo sapiens
  misc_feature 2: y=c or t
  misc_feature 25: s=g or c
tyattagatgtctccagggaaacasaactaataggacacacacacacacacacacac

SEQ ID NO: 33228 - DNA, 242 bp, Homo sapiens
  misc_feature 153: k=g or t
aaaatgatgacagggaaccaaatgatctcagagtatctggttggtgtctagtctccctcagaaatgttgcatttagagcagtgcacacagtagacacttaataaatgtcattgaccatctatgaccagtttcctgtttagttcgttttctgtkttgttttttgagacagggtctcgctctgtcgcccaggctggactgcattggtgtgaacacgactcactacagcctcagcctgccaggct

SEQ ID NO: 33229 - DNA, 185 bp, Homo sapiens
  misc_feature 85: k=g or t
  misc_feature 89: r=a or g
  misc_feature 92: s=g or c
  misc_feature 100: s=g or c
  misc_feature 101: r=a or g
  misc_feature 109: r=a or g
  misc_feature 111: r=a or g
  misc_feature 115: r=a or g
  misc_feature 120: r=a or g
tatagatttgatttttttatttatttaactttaatttttgtagatacacagtaggtgcagatatttatggcgtatatgagatgtkttgrtgsaggcatgsratgtatartratcrtatcrcagaaaatggggtatccattccctcaagcatttatcctttgtgttacaaaccatccaattatact

SEQ ID NO: 33230 - DNA, 391 bp, Homo sapiens
  misc_feature 144: s=g or c
  misc_feature 145: r=a or g
  misc_feature 148: b=c or g or t
  misc_feature 149: h=a or c or t
  misc_feature 334: s=g or c
tctcctacaaattacatagtaatttgtcttaaatattaaaaaaggttatttatttatttattgagacagggtcttgctttgttgcccaggtcagagtgcagtgacaccatggttcactgcgaccctgacctcctggactcaggsratbhtgcctcaccttccagagcagctgggactgcaggtgcgtgccaccatgcttggctaatttatttgttttttgtggggacggggtttcgctgtgttgcctaggctggaaaataagcgaactcttggactcaagcaatctgcccgcttcaacctcccagaatattgggattacaggtgtgagccactstgcctggcaaaagtcacttatttttaattgtggtaagattcacataacaaggagaat

SEQ ID NO: 33231 - DNA, 131 bp, Homo sapiens
  misc_feature 114: r=a or g
  misc_feature 115: r=a or g
  misc_feature 126: k=g or t
ggttccgtccacgccggctctagggagggggcggtgttccgtggccgcctccctggcggcgctggggaaatgagcaggtaggaggccgacagcgacctccacgtctcggagcgrrccgtgaggcckcccct

SEQ ID NO: 33232 - DNA, 192 bp, Homo sapiens
  misc_feature 76: y=c or t
  misc_feature 111: k=g or t
  misc_feature 119: s=g or c
  misc_feature 132: k=g or t
actttgctgaagttgtttatcagatcaagaagctttgggaagagatgatggggctttctgggtatagagtattatyatctgcaaacagggatagctttgacttcctctctkcctatttsggtgcctttcctktcttttcttgcctcatggctcaaagctaggacttccaatattatgttgaataggagtgct

SEQ ID NO: 33233 - DNA, 250 bp, Homo sapiens
aagggacattttttaacctgttattttaaatgccacatatatgttgtaatgctgaagcatacaggtagaatttctggatcgtaactactagtgacttctgaggtttacagttagaaaatgttctcaaaggtttatcagttatgtattgatgattggtaatctagaccctctggaggctgtagaatgtgaaaagatacagctgagctgacaagttttagggcactatcttctggaatgaaatcggccatca

SEQ ID NO: 33234 - DNA, 343 bp, Homo sapiens
  misc_feature 27: n=a, g, c or t
  misc_feature 328: n=a, g, c or t
  misc_feature 329: d=a or g or t
  misc_feature 330: y=c or t
catgactccatagaccttttcatttgntgggtttttatttcctatgatgtatactgccactaaccttccaaaaattacttagtattgcaaagtcaggaaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccndycatccaattagct

SEQ ID NO: 33235 - DNA, 126 bp, Homo sapiens
taaggtaggtttgttagtttgttttttggtaaaaggaatgtcacttgcttagagaggttaatatactgcatgtggggcaaagttgctggtaagtatcattcttccttctgtccttcgaacccccca

SEQ ID NO: 33236 - DNA, 182 bp, Homo sapiens
  misc_feature 47: n=a, g, c or t
attgtgaacataccatggcctattggatgaatcatttgccgtagtanaatcagactgtagggtttgtgatggatttatggagtatgtgggtatagaaatcatgaatctagcatttgttttcagagattcaagcatagtcttaagggtagatcagaaatgacaaatgaattcaaaacctaaca

SEQ ID NO: 33237 - DNA, 237 bp, Homo sapiens
caatattctttcattccttatgcttgctttggttttaatttactctttttcttaaggtggaggttagaacattgattttttttctttcttcctttttaatgtagttattgacagccataatttctctctaagcaggtgctttacctgcatcctatactttggtgtgttgtgtttttgttttcatgcacctaaaagtattttaaaatttactccaagatttcttctttgacccactta

SEQ ID NO: 33238 - DNA, 110 bp, Homo sapiens
  misc_feature 30: k=g or t
  misc_feature 68: k=g or t
  misc_feature 69: k=g or t
  misc_feature 78: r=a or g
  misc_feature 87: r=a or g
caaattaaaagtataataagcaatcaagtkattagaccaaacatattcaacattatataatattagakkgtgataagrgttactgaraaatttaagaatacagcaggctt

SEQ ID NO: 33239 - DNA, 187 bp, Homo sapiens
tgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacat

SEQ ID NO: 33240 - DNA, 295 bp, Homo sapiens
  misc_feature 263: k=g or t
ctaagttgtgcagttctaaaagcagagtatttttttttctcataaacaaaaaatccagtttttaagttgagattttcgttggttcccaggaaggatggaatgaatacaatattaagcattgatttagaaggatgaatgtcagctgaaatttaagaaacccctttgtaaataacccaggtctctataggagggtcgtagatagcattttatgtctttctgacctccaacctgaagtgaaacataaggcattgtgctcatgactkttgatctctccaagtctgacattcgaatcgat

SEQ ID NO: 33241 - DNA, 143 bp, Homo sapiens
ttctttccagggaagaagggcggggatgtcagggctggagagtgcccgtgtccttctgtgtgcattgggctccttcctccttaattctctgctttccacttttaggctgaactccagtgcacccagttagacttggagcggcc

SEQ ID NO: 33242 - DNA, 215 bp, Homo sapiens
  misc_feature 157: s=g or c
  misc_feature 158: r=a or g
  misc_feature 167: r=a or g
  misc_feature 170: s=g or c
atacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttsraaaaaaaargtscacaatgtaggttaacagtagagggcttaagtaacacccctctaa

SEQ ID NO: 33243 - DNA, 380 bp, Homo sapiens
cagtatcccctctgtgacctggtttgaccgctgttttgcctaggtgtgatgtttttgaatacattattgagaacctgttgtgctaggcactcatcaacaatatttctaatcatcacagcaacttgaacgatattttcttcatcaataaaaagagaatgaggttcagggcagtttagtaagatttcctagggcacttcaaagttgtccagtttattgcttcccgaccctaatgctaccctcgatcggggctctttcccattttaccctgatcctcaccctcccccaaatgcccttagggtaataagtggtacaccaggaagactgctacttataactgttcattttcaaggaaacttaggtatctgtgcaattaaatacca

SEQ ID NO: 33244 - DNA, 291 bp, Homo sapiens
  misc_feature 37: k=g or t
  misc_feature 46: s=g or c
  misc_feature 97: k=g or t
  misc_feature 105: r=a or g
  misc_feature 107: w=a or t
  misc_feature 245: k=g or t
ttgtgggtcctactgaggaaaggatatgatcgtgtgkctgtgatgstccacagccaggagacacggcggtatatggaaaagatcctcttccctgtakgagctcgrawtttcatgggagaagaaattatgagagaatgcctgtctcctttcagtcacctggcttgtggatttgctatccccaggtgaaaccaaggccctactggactggccccaggctgattcctggaggaagctacttttcagakgggcacacaggttatctcatggacaggttcttcagggtgtcttcta

SEQ ID NO: 33245 - DNA, 166 bp, Homo sapiens
  misc_feature 109: r=a or g
agacacacgcatagcacacacatgagcatgcacacgtgtgcgcactcccacacatctacgcatgcacacacccataccatcacacaccacacacgcgcacacagatgcrcatacatgcactcactgcacacaccgttgtacacgatgcacactacaagccacatac

SEQ ID NO: 33246 - DNA, 110 bp, Homo sapiens
ttgcagtaattttgttggtagattgttaaatatgttggtacttgaaaatgaccacggttcatggatttacaccactggaatctgaaaatgctataaatcaatcctttttt

SEQ ID NO: 33247 - DNA, 56 bp, Homo sapiens
  misc_feature 7: s=g or c
  misc_feature 28: r=a or g
  misc_feature 29: w=a or t
cgcttasttaatggtcattaaatgcagrwactacttgctaagagctttatgtgtgt

SEQ ID NO: 33248 - DNA, 163 bp, Homo sapiens
  misc_feature 84: k=g or t
  misc_feature 86: k=g or t
  misc_feature 91: y=c or t
  misc_feature 109: k=g or t
  misc_feature 110: k=g or t
  misc_feature 154: k=g or t
tatttatgaaatctaaggtcctaatagaatcgtatatttaaaattctagtattgccacattaccttctgtaattttgtaccagktkatacycctgcaataggtaggtgkkacacagattcccattaattcacacttcacccaagttgtgtgtgkgtcagtgca

SEQ ID NO: 33249 - DNA, 281 bp, Homo sapiens
  misc_feature 93: k=g or t
  misc_feature 120: k=g or t
  misc_feature 136: k=g or t
gtaactcctgttgtatctctcttcaaactatatccagaattgaccatgtcccaatacttccattgctactgtcttagtcccagtgtcatcttktacctgggattattgtaaaggcctcgkaactagtcttcctgtktctgcccttcccttctctgcccatctattctcaacacagtgttgcttttaaaacaaagtaagatcgtgccactcttctgctctaaattccccattggtttctcatctcaaactaagggccagtcataatgccctcacggtcccat

SEQ ID NO: 33250 - DNA, 109 bp, Homo sapiens
acacactgacctgactctccttggaatcgccgcgacctcttaaaagctgaacttacttccctaaacttcttccacttctgggcccctcgcccaactccctccccctctc

SEQ ID NO: 33251 - DNA, 106 bp, Homo sapiens
  misc_feature 12: r=a or g
  misc_feature 47: w=a or t
  misc_feature 55: k=g or t
  misc_feature 71: k=g or t
  misc_feature 82: y=c or t
tatacatccagrcactaatatagcatctgctgtggagtagccacatwggaaatgkttcttaaagtgactgkgatttgtctcytttttttttttttttttttttttt

SEQ ID NO: 33252 - DNA, 329 bp, Homo sapiens
  misc_feature 159: r=a or g
  misc_feature 166: r=a or g
  misc_feature 270: n=a, g, c or t
  misc_feature 271: k=g or t
  misc_feature 273: d=a or g or t
agttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttrcgctgarggctctgcagtggctgggaggaccccggcgctctccccgtgtcctctccacgactcgctcggcccctctggaataaaacacccgcgagccccgagggcccagankadgccgacgtgcccgagctcctccgggggtcccgcccgcgagctttcttctcgccttc

SEQ ID NO: 33253 - DNA, 212 bp, Homo sapiens
tcagttaacatttattggatgctcactgtatactaggcactgtgtgaggatctgaagtaaggtatagattctacccactagaagaagttcacgttctggtatagtgtttttcaaactttgactcagtctgttagcaagttctgaaattaaaaatcagttggtcatattatattataacccatagtataaaataaaatatctgtgaggcccgc

SEQ ID NO: 33254 - DNA, 238 bp, Homo sapiens
  misc_feature 181: k=g or t
cattgtctggtttgtatatttccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaattkggctttgcctgtaatcaggttcagcaaaagtggtattttctttctttcttttttttt

SEQ ID NO: 33255 - DNA, 178 bp, Homo sapiens
  misc_feature 75: m=a or c
  misc_feature 85: r=a or g
  misc_feature 91: w=a or t
  misc_feature 92: d=a or g or t
  misc_feature 94: v=a or c or g
  misc_feature 95: y=c or t
  misc_feature 117: w=a or t
  misc_feature 118: r=a or g
  misc_feature 119: r=a or g
  misc_feature 132: k=g or t
ttctgtttgctaaatctcactgtcactgctaaattcagagcagatagagcctgcgcaatggaataaagtcctcamaattgaaatrtgacawdgvycctcaacatctcccatctctcwrratttctttttgcktcattattcctgctaaccaattcattttcagactttgtacttcaga

SEQ ID NO: 33256 - DNA, 102 bp, Homo sapiens
  misc_feature 28: k=g or t
  misc_feature 29: k=g or t
  misc_feature 57: k=g or t
  misc_feature 58: k=g or t
  misc_feature 89: k=g or t
taattaaccccacaaattttggtgcatkktcatttatgttcaaaatattttctaatkkcttttgagaattgttctttgacccatggatkatgatgatgatgc

SEQ ID NO: 33257 - DNA, 129 bp, Homo sapiens
  misc_feature 90: r=a or g
cactcccctcgggggatgttgtctcactgtgctgggaggatttgtgttcccagggcagagaccagcactctgccccacccctcttgcctrgcagggttggtggacctgggtgtctctctggacacatcc

SEQ ID NO: 33258 - DNA, 98 bp, Homo sapiens
  misc_feature 86: s=g or c
  misc_feature 89: m=a or c
  misc_feature 94: r=a or g
tacgagtttcaaacacggttggttttcacccctgagctagtcaggcaagagtagagtcagccaaagaagactaggtacacacccascamacacrgaac

SEQ ID NO: 33259 - DNA, 300 bp, Homo sapiens
  misc_feature 46: r=a or g
  misc_feature 47: r=a or g
  misc_feature 85: s=g or c
  misc_feature 91: k=g or t
  misc_feature 98: k=g or t
  misc_feature 103: k=g or t
  misc_feature 106: k=g or t
  misc_feature 111: k=g or t
tctctgtattcaaatttgattgtggcgaatctacttcaaaaaggarraataatccaactttgtggatattaaatggaaggtttgstgtgtkgaattckagttkgtktccaktggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctgtt

SEQ ID NO: 33260 - DNA, 294 bp, Homo sapiens
  misc_feature 26: k=g or t
  misc_feature 79: b=c or g or t
  misc_feature 80: s=g or c
  misc_feature 87: k=g or t
  misc_feature 93: k=g or t
  misc_feature 94: k=g or t
  misc_feature 98: k=g or t
  misc_feature 99: r=a or g
  misc_feature 140: k=g or t
acgcgactgggactaggccggaggakcgggggaccggcaggtgggccgctcagtgcgttgaaggattcgatccccagtbscgtccckccccakktctkrgggcggccccaaaccgctccaggcctgagaggctgtaggtkccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcataat

SEQ ID NO: 33261 - DNA, 284 bp, Homo sapiens
  misc_feature 96: k=g or t
  misc_feature 97: r=a or g
ccatcacgttgttataaatcttcatcattttatgtaagatttttttccctcctctgtggactggatcctctgggtgagttcctaaaaccagggatkrttcggtgagggagtggttcctgacccccaggactgtgaggactgcacgccgcatggcctgctccctgggagggtgacgggtttgcctcccgcctcccacacaaggcgcacaccagcgggcacagcccggtgacctgcacgtctgagtccaggatgccagtgatgtttcttctcctcctgccccgttc

SEQ ID NO: 33262 - DNA, 61 bp, Homo sapiens
tagacctggatttggtcaaggacttcaaacagtgccctcaggagtgcacccctgaaccgca

SEQ ID NO: 33263 - DNA, 166 bp, Homo sapiens
agaaatgtttgtagtcatacctgtgtgatttgtatattttctctattttttggtctcatttgtacttagacaaagaggcagctgaacgtctttcaaaaacagtagaatgaagcatgtctgttactagcagaatataacgggcgcctggcagcagaactggaggacg

SEQ ID NO: 33264 - DNA, 381 bp, Homo sapiens
  misc_feature 105: w=a or t
  misc_feature 354: r=a or g
aatgttcaaatggtgtgtggaagcaaaaaattacagccagtatatgagaccactattatggttttttaaaattaacttggtctagtaaaagtgatatcaagagtwaatcttagaaacttgctcagtaaaaacattttctagtataacatgttctttaaaaagcaaatgctgccgtctttggaatcttaatctaaaaatgtggccgggcgcggtggctcacgcctgtaatcccaacactttgggaggctgaggcgggtggatcacaaggtcaggagttcaagaccagcctggccagcatggtgaaaccccatctctactaagaatagaaaactcagccgggcgtggtggcgggtrcctgtggtcccagctactcgggagctc

SEQ ID NO: 33265 - DNA, 178 bp, Homo sapiens
  misc_feature 108: k=g or t
  misc_feature 147: k=g or t
  misc_feature 148: k=g or t
cttgctagacttgggaagtttcatttattattttgctaaacaggttgtgaaccttttgttatcttttcatatgccgagataccagtaatttatttatttggtcacttkgtggtgtcctatatattgtaaagattttgtaattctttkkcattcttttaaaaatgtttgcctggtttgc

SEQ ID NO: 33266 - DNA, 69 bp, Homo sapiens
caatgtattcacttgaagtcttgatccaacgtctaccctctggcaatgtatagaattcttttttttttt

SEQ ID NO: 33267 - DNA, 299 bp, Homo sapiens
  misc_feature 90: w=a or t
cggtaatttttgaaaggaaaaatgtataacaagtactatttacatatctgcatttaaaaaagcaattcttagaatacttcctttacattwattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgccc

SEQ ID NO: 33268 - DNA, 229 bp, Homo sapiens
  misc_feature 81: k=g or t
  misc_feature 84: w=a or t
  misc_feature 86: d=a or g or t
  misc_feature 88: r=a or g
  misc_feature 98: k=g or t
  misc_feature 109: k=g or t
  misc_feature 125: r=a or g
  misc_feature 220: d=a or g or t
tacctaggctttatgggatagtctgttgcttctaggctacaaacctgtacagcatgttactgtactaaatactgtaggcakttwtdarcaccaacggktaagtatttgkgtatttaaacatagaraaggtacagtaaaaatataatataaaagataaaaaatggtatacctgtgtaggacacctaccatgaatggaccttaaaggattggaagttgtttdggtgagact

SEQ ID NO: 33269 - DNA, 198 bp, Homo sapiens
attggctgaaacgtgaatgtgatggtggacactttggactatgaggatgaaggcaatactttggagacagcaaggcaaagcgttaaaaagagcttgagctctcaacaccgctgctgaacagatgcaccccatcagcagggactttctacctgggagggtaattgtttcaattatcttctttttctttttttttttttt

SEQ ID NO: 33270 - DNA, 85 bp, Homo sapiens
  misc_feature 14: y=c or t
  misc_feature 15: y=c or t
  misc_feature 55: b=c or g or t
ctgaagtctatttyyccaatagtatacaacctcagatggccctgctcaacaaatbtaggacccaccttccctccaccagttcccc

SEQ ID NO: 33271 - DNA, 169 bp, Homo sapiens
  misc_feature 92: r=a or g
  misc_feature 96: s=g or c
tagtagagatgggatttcgccacattggccaggctggtctcaaactctgacctcagacaatccgcccaccttggcctcccaaagtgctgggrttasaggcatgagccaccatgcctggccaaaaataatttctataattaaaatgctaaatgaatagggactggagctg

SEQ ID NO: 33272 - DNA, 72 bp, Homo sapiens
  misc_feature 52: k=g or t
aagtctagaaggactctgcacatagattacttcatgaatgtttttagttttkgttctttataaaaactagga

SEQ ID NO: 33273 - DNA, 384 bp, Homo sapiens
  misc_feature 24: s=g or c
  misc_feature 71: y=c or t
  misc_feature 78: y=c or t
  misc_feature 97: m=a or c
  misc_feature 129: m=a or c
  misc_feature 152: y=c or t
  misc_feature 256: y=c or t
  misc_feature 298: y=c or t
  misc_feature 338: m=a or c
  misc_feature 370: y=c or t
cctgagtcctgtcacctatttctsatttatattgacccttcatagcttgtatcatcttcttaacatctttyagatgtyagatattattttgacatamaaggttaatagtggaccctcccgtaattgcamgaaggcaccatcctccccatttyaggcactgttctctaattggcctgccttcctttctggtgaatccctattggctctcttggggctcttgcattctcaggtctgtggttacattgttgcttttctyttctttctcctgcctagatcctggcattgctacttgtatttytctttctgatactgccatactaactcaatgttatgttgamaataatgtttttcttaatttataaagtaagtyattttgtttcagtc

SEQ ID NO: 33274 - DNA, 267 bp, Homo sapiens
tgctgtaacattatttttctcccttaacaacttcctctattggtttacattttctatttcctctggagtatgttttagtaagttatactttcattgagaattacccattttctccaagtttccaaatttatctgatagagatgagcaaagtatcctaagattccttcccccccccgtatttgtggttatctccctaagatcattttgtatattcttctttgcttaggatggccattttatttttacatacctcctcccttcccccac

SEQ ID NO: 33275 - DNA, 79 bp, Homo sapiens
ccaatatttgctattataagaggcatccaagcatttctgaccaggtcccttttttctttttggattatttccttttttt

SEQ ID NO: 33276 - DNA, 173 bp, Homo sapiens
catttaaggataccattaaattagctgaaatatttaacaagaaataggagacaggggagacatatgatagctgtttccaaacgtaaagggcattcatagggaagggacattttctgggtccctattttatgccatagatgctgggctagacactttaattgacatcaccccct

SEQ ID NO: 33277 - DNA, 212 bp, Homo sapiens
tacaacaacttccggcccaccctggagactgttgactctggcacagagctccacatccagaggccggagatggtagcatccactgtgtgagccaacgggggcctcccaccctcatctagctctgttcaggagagctgcaaacacagagcccaccacaagcctccggggcgggtcaagaggagaccgaagtcaggccctgaagccggtcctgc

SEQ ID NO: 33278 - DNA, 163 bp, Homo sapiens
agaagggacagactatttctagatgcttcttttaacaatcgatgttttctgcttgtgtaactgctcaagctgaaaaagttagcaattaccacccagtgtgcaaaatagcattttattcgttctgaaaacacccctcttaaaccttaactaaaagagcacctac

SEQ ID NO: 33279 - DNA, 265 bp, Homo sapiens
tacatgattttcatgttaattgtaaatgttaattccctcttgcaagggagacatatcctagatcactttgctttttctttaaggagctgatgttgcacctaaacattccaacccttaaagctaaaacagcacaaaaaaaatttcacttttgaaatgaaatttttataattgtatggcaaaaggctatgtaaaaacaaatcttgcatcttaagacaaatattcttttatttctgttaaactgaatatacaattgttccctaggcct

SEQ ID NO: 33280 - DNA, 165 bp, Homo sapiens
actttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacc

SEQ ID NO: 33281 - DNA, 417 bp, Homo sapiens
  misc_feature 365: b=c or g or t
tactttctgtctctatggatttgcttattctggacatttcatttaaatagaatcatacaatatgtggtcttttatgcccagcttctttcacttagcataatgctttcaaggctcatccttgttgatgtattagtatttctttcctttttatgactgcataatattccattgtatgaatataccacatattgtttgtccattcaattgatgggcatttaggttttttctgcttgttggctgttgtgactaatgctgctataaacattcatttacaagcttttgtgtagatcatatgtttttaattctcctaaaagtggaattgttgggtcttatggtaactctgtttagtttttggaggaattgcbagactgtctttaaacagctggactattttgcattcctgtcagcaatatatga

SEQ ID NO: 33282 - DNA, 182 bp, Homo sapiens
caggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggt

SEQ ID NO: 33283 - DNA, 274 bp, Homo sapiens
  misc_feature 230: k=g or t
  misc_feature 231: k=g or t
  misc_feature 239: k=g or t
  misc_feature 252: k=g or t
agtgattctcctgcctcggcttcccgagtagctgggattgcaggcgcctgccaccacgcctggctaatttttaaattttagattttaaagacagggtttcaccatgttggccaggctggtctcaaactcctaacctcaggtgatctgcccacctcagcctcccaaagtgcagggattacaggcatgaggcaccacacctgacccaatacactgtttcattttcctttttkkttgttttkttttggttttttkgagacagtgattcccccgcctt

SEQ ID NO: 33284 - DNA, 182 bp, Homo sapiens
  misc_feature 73: d=a or g or t
  misc_feature 101: y=c or t
  misc_feature 103: y=c or t
  misc_feature 105: k=g or t
  misc_feature 107: w=a or t
  misc_feature 114: d=a or g or t
  misc_feature 151: k=g or t
agaggatgatgcttatgacttcagtacagattatgtgtaacagaacaatggctttttatgatttttttttttdaacattttaagcagactgctaaactgtycyckgwataagtdatggtatccatgagctgtgtaaattttgtgaatatgkattatattaaaaccaggcaacttggaatccc

SEQ ID NO: 33285 - DNA, 167 bp, Homo sapiens
  misc_feature 88: d=a or g or t
atacaaaaattagctggtcgtggtggtgcccacctgtagccccagttactcgagaggctgaggcaggagaatcgcttgaacttgggadgcggaagttgcagtgagccaagatcgcaccactgcactccagcctggcgacagagcgaggctccgtttcaaaaaaaaaa

SEQ ID NO: 33286 - DNA, 264 bp, Homo sapiens
tagtaccaaggggcggcttggactgcggatggtggggtagtttagctcatcctaaatctccattcaggctgggcacagtggctcacgcctgtagtcccagcacttttcaaggccaaggcaggtggatcgttcaagcccaggggttggggacaagcctgggaaacacagtgagacctcacacaccacacacacacagacctcacacaccacacacacagacctcacacacaccacacacacacaaacctcacacaccacacacag

SEQ ID NO: 33287 - DNA, 179 bp, Homo sapiens
  misc_feature 95: s=g or c
  misc_feature 107: k=g or t
  misc_feature 108: k=g or t
  misc_feature 139: k=g or t
tatccgacctattcacagacattaaaaaggggcatgtcctcctggatctgctagaagtactttctgggcaacagttggtaagatttttaaatgasactgagaaactkkctgttgacttaaaaaatatgtatttcatttkttctgagtaatatatttgcttgaatttcacagcctcatgg

SEQ ID NO: 33288 - DNA, 223 bp, Homo sapiens
gaaattaattaagtgctacctaaaaatatcaaaatgtcaggtacaagaatttggcattttcaaaattagtaattacaatgtaagtttgccctattataatgatacccagctatgtccagtaacataactagattgttctgaataccgttattatttcccaataatacaaacatcacaatttcagttctgtagtacctggcctacctacccttcccactgcccc

SEQ ID NO: 33289 - DNA, 158 bp, Homo sapiens
  misc_feature 93: r=a or g
atacaaaaattagctggtcgtggtggtgcccacctgtagccccagttactcgagaggctgaggcaggagaatcgcttgaacttgggaggcggragttgcagtgagccaagatcgcaccactgcactccagcctggcgacagagcgaggctccgtttca

SEQ ID NO: 33290 - DNA, 389 bp, Homo sapiens
  misc_feature 114: k=g or t
tgaacagttccaaatcacagtaagcacatagaggtcagtgggtttggatcaaatcccagctcacccctcattatatgaccttacacatcacttaacctcccttagcctgttttkcttttcttcatctgtgtaacagcaacaatgcatgccacctgccacatatccctcatgggcttgttgtaaaattctgagaagatgatgggtttttcagtaccatgtccagcacgtggtacacatgcaacaaccacccaatctgatccgatcctgttggtaacactggcgcctcttgtttgggagtgagactccctcagtagaggttgtggattaagtactagggatcttctgactgattgtggcagccttgatgctgataaaactttggggagtgc

SEQ ID NO: 33291 - DNA, 232 bp, Homo sapiens
catggtgatggagccctgggagcaggccaggcttgtccttggccattttctcctgcacattggccttttacactaggggcagccatgggaagctccttgaggccttgttagtgtccatgcgtgtcttgttagtcagtgcatttgcagcccatcatacagtgcctggcacgaagttgagtaaagaaatgaatcctctgtctacctctggggagattgtcaaccactgtgggtc

SEQ ID NO: 33292 - DNA, 74 bp, Homo sapiens
  misc_feature 42: s=g or c
agttcgcgccggcggtagacgaggacgccaacagcagcggasaaacgtttctctttcctctcagtttgcgcact

SEQ ID NO: 33293 - DNA, 205 bp, Homo sapiens
aaagtgatgcagaaattgctgcttctcacaaggccatgacctctccctaacctagatcctgtaaggtgtgtattggtcccatttagcaggtaagacaatgaagaccagaggtccagcaccttgcctaaaccacacctgctgggatttggattcaagtccaaccgtacagctcaaacgctcagccacttccctaaagtccacccca

SEQ ID NO: 33294 - DNA, 172 bp, Homo sapiens
tacaaaaagattagtcaggtgtggtggcgggcgcctgtggtcccagctactgggaaggctgaggcaggagaatttcttgagcctgggaggtggaggtttcagtgagctgagattgcactactgcactctagactgggtgacacagcaagactccatctcaaaaaaaaaaaaa

SEQ ID NO: 33295 - DNA, 75 bp, Homo sapiens
  misc_feature 10: k=g or t
  misc_feature 23: s=g or c
  misc_feature 24: r=a or g
tccactgaaktcttgatcccctsratcatccatgaggtttggaatcatcttctcaactcctgtaaatgttgacat

SEQ ID NO: 33296 - DNA, 79 bp, Homo sapiens
ccagtcaatgacgtagatgttggggtgtaccagctgatgcagagtgaacagcttctctcacgcaaagtggagtccttat

SEQ ID NO: 33297 - DNA, 291 bp, Homo sapiens
  misc_feature 269: v=a or c or g
  misc_feature 270: y=c or t
ctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaattttttttttgggacggagtcacccaggctggagtgcagtggtgagattttggctcgctataacctcttcvyccagggttcaggtgattctcc

SEQ ID NO: 33298 - DNA, 165 bp, Homo sapiens
tacaaaaaaattagccaggcgtagtggcaggcacctgtagtcccaggctgaggcaggagaatggtgtgaaccgaggaggtggagcttgcagtgagccgagatcgcgccactgcactccagcctgggcgactgagcgagactccgtctccaaaaaaaaaaaaaaaa

SEQ ID NO: 33299 - DNA, 146 bp, Homo sapiens
taattcaagtgtgttattcatttgtcttagtctgtttgggctgctgtaacaaagtatagtacctcacagtgggtaatttataaacaacagaaatttattgcccagaactctggaggctaggaagtccaagatcaaggtcccatgca

SEQ ID NO: 33300 - DNA, 392 bp, Homo sapiens
cccgggtgagactgaccacggggtcacttgtcacagtcttctgctggcagccagctcctccagggcagggtcgcatctgactctgtcatctctgcttttcctggcatggcacagggcagaggcttcatcctgtttatcgatggagcgagcccaggcttcccgtcgtcagtgccactgtgtctcacagtgccttcctcacccagggcaaagggcatttagaacctgacacctgacaacctcccagggtctccaccgtctcacacccacgcgctccctggaggccactcactcagccccttggttgggaacataacgaggagatggcatttaaggagccagtgatcttcgagcaccttgaaggtcatcttgcctgtgctccacagcagctcctt

SEQ ID NO: 33301 - DNA, 312 bp, Homo sapiens
  misc_feature 108: r=a or g
tctgtgtcctacttaaattggcttgcagtagaattatagttaaattgatgcagggcaggtaagccccaaaattgggcttagaccgggaaggttcttgggtttgctcarggaaagaattcaagagtgagggctgggcacggtggctcacgcctgtaatcccagcactttgggaggccgagacaggtggatcaccttaggtcaggagttcgagaccagcctggccaacgtggtgaaaccctgtctctactaaaaatacgaaaattagctgggcatggtggcaggcgtctgtaatcccagctacttgggagcaca

SEQ ID NO: 33302 - DNA, 313 bp, Homo sapiens
tttaaaattatactttaagttctgggatacatgtgcagaacatgcaggtttgttacatagatatatgtgtgccatggtgatttgctgcacccatcaacccgccatctacattaggtatttcttctaatgctattgcttcccttgccccccacccactgagaggccctggtgtgtgaggttcccctccctgtgcccatatgttctcattgttcaattcccatttatgagtgagaacacatggtgtttggttttctgtccctgtgttagtttgctgagagtgatggtttctaagcttcatccatgtccctgcaaa

SEQ ID NO: 33303 - DNA, 205 bp, Homo sapiens
  misc_feature 17: s=g or c
  misc_feature 97: w=a or t
  misc_feature 102: w=a or t
  misc_feature 126: y=c or t
tccaaattgataagaasaggagggaggtgtagcatcaagggaaaagtctttgggagtaaaaaaaagagtggaaacttaaatcaaaatataagtcctwttctwgctctgtcttctagtgaaaatgtyattctgtgttagagaaatgaccagatgaattgtgtttcctgtttcgttttgcagttctcattaaagtgggtacacgcat

SEQ ID NO: 33304 - DNA, 176 bp, Homo sapiens
  misc_feature 46: k=g or t
ttgtgcatgctttaacaatttattacttttaaatctagagtgaatkcgagagactgccgctaaagatctgagttttaaaaatgttgttgctggtggatttcttgttcctgttacataactaaaagtgaggccatttgtggtttttaaaaaccttatgaattaaaaatgctacaggc

SEQ ID NO: 33305 - DNA, 331 bp, Homo sapiens
ttgctgggttcagtggtaggattatctcatgattcctacttgtacagaatgattagttttgcttcttcacattttggagtttagatgttaagatttcacacagtcttggcttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggagccac

SEQ ID NO: 33306 - DNA, 326 bp, Homo sapiens
  misc_feature 293: r=a or g
  misc_feature 311: s=g or c
cacaaaccacctcctcacctgggcctcctatggttcagagcacagtctcagcaaatcctcccagcaatatcaacagcgctactctaaccagagctgcagggacaactgcaatgagaagtggcttgcccagacccagtgccccttctgctgggggcataccagtgcctcgcagcaaacttgcacagcctgttcgcaggtaagtggcagatgttctgtttcagcattcttgagtgcctgaaagtggatagactggaatgaattaggcttcatccgtatgtttgatagtaaacagraagtcatggtggattccsaccagagttttagta

SEQ ID NO: 33307 - DNA, 114 bp, Homo sapiens
  misc_feature 89: w=a or t
  misc_feature 90: m=a or c
tataatttaagaagtctggaatacagagtgtaacactgtgtactgctagcacccaaagtggaaaatcttaagcattcagattgtttagwmaaagaagaaaaccagaaggacagc

SEQ ID NO: 33308 - DNA, 109 bp, Homo sapiens
ccattttccctcatgaatagactcaccagcattttacccccttgttataaaactgtgcagagcaagaagatgatacttatttttgaatttgtatttttaaaactagatt

SEQ ID NO: 33309 - DNA, 157 bp, Homo sapiens
catcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacaccc

SEQ ID NO: 33310 - DNA, 303 bp, Homo sapiens
  misc_feature 46: k=g or t
  misc_feature 185: s=g or c
cagaaggaaagcagtggtagatggtttgggggttgtttttgttttkttgatttgcaacgaagtcttgctctgttgcccaggctggagtacagtggcgtgatctcggcctatgacaacctccgtctcccggcttcaagcgattctcctgctcagcctccggagtggctaggactgcagctgcgcasaccatgcccggctaatttttgtatttttagtagagacagggagtcctgacctcgtgatccacccacctcggcctcccaaaatgttgggattacaggcatgagccaccgcacccggcgc

SEQ ID NO: 33311 - DNA, 64 bp, Homo sapiens
  misc_feature 10: d=a or g or t
  misc_feature 22: r=a or g
  misc_feature 43: r=a or g
gaccaaaaadtcacttcagggracacagtaaaaggtgactgartcaatctaggttaaaaaaaaa

SEQ ID NO: 33312 - DNA, 324 bp, Homo sapiens
  misc_feature 219: y=c or t
ttgcttttatgcacaagaaggccttagctcctgaaactttcttctgagactttcctgtgatctttctactttctgctgtgatgttttcctggttgaaccaagggcacacttatcctttttccttcattctgaatcactcacctgacttcaggtgttacctcttcccctgacatgctaaaattgtaggtgatcataaatattattcactgtgtgtgtgcyccccaccccctgccttggttttcacagagcttaggatgtcatggaagtatctcagggtccgttggagatatggcactgaggtgtaggcttgataattggggcagc

SEQ ID NO: 33313 - DNA, 157 bp, Homo sapiens
aaaagatctctcatcatgaagtagtagatttgaagaaaaaaagcacattaaatcctaaagactatgtttcctaaaagtcttcccctcttctgccacataaaaggaaggcctcaacttcaaggaaaaagtgtatatataccttttatatacccggcat

SEQ ID NO: 33314 - DNA, 297 bp, Homo sapiens
tgcgggtgggatgcgatgtaccacatttgtgttcatgaggggcctggatgccgtacgggcggacgcagagtctcagaggagactgcactggaagctgacagcacggtccttagagtcaaatttcgtctgtccatttgctcagtagccctgggtcttgactcacaggtggaatgggagtgcaaactcagtacatgaaggacagaactgactgtccctggaccataatagaaactcattctagaagttcaacatgaaactcattctagaagttcaacatgaaaaagttaggaagaacgc

SEQ ID NO: 33315 - DNA, 351 bp, Homo sapiens
  misc_feature 204: s=g or c
  misc_feature 205: s=g or c
atctttgggcagcagcccagcagccctcagctgcgccaagtgaaccggggagatctgacggatatgaagaagtgaggggagtcactccttggcaccatcagtccaaccccgtgaaatccccatcctgggaaggagcctgcatctcaggtaaggagactcagagtccggttccagctccaccactgatgacttgagtggacttassacatcatttaccaacaatcacaaagacttctgggacatctgccacctacaaggtcccgaaagaattcccagaggagcaaaacacagtcctgacctctccggtctcagtgaagatgagtcctgcactccacagcacatgggccatga

SEQ ID NO: 33316 - DNA, 50 bp, Homo sapiens
  misc_feature 34: k=g or t
ccattgagacctcttgaaaattcaagcaagatcktcaggttcttgcaatt

SEQ ID NO: 33317 - DNA, 303 bp, Homo sapiens
  misc_feature 185: s=g or c
cagaaggaaagcagtggtagatggtttgggggttgtttttgtttttttgatttgcaacgaagtcttgctctgttgcccaggctggagtacagtggcgtgatctcggcctatgacaacctccgtctcccggcttcaagcgattctcctgctcagcctccggagtggctaggactgcagctgcgcasaccatgcccggctaatttttgtatttttagtagagacagggagtcctgacctcgtgatccacccacctcggcctcccaaaatgttgggattacaggcatgagccaccgcacccggcgc

SEQ ID NO: 33318 - DNA, 321 bp, Homo sapiens
  misc_feature 232: k=g or t
  misc_feature 233: k=g or t
tcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgkkccagacagggacacggctcactccagctgacaaagcagagcacatgaagcgacaaagacaccccagattgcgcccccagtcagccgga

SEQ ID NO: 33319 - DNA, 187 bp, Homo sapiens
  misc_feature 7: k=g or t
gtgtttkatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctccccccccaagagaaagtacacaggtgct

SEQ ID NO: 33320 - DNA, 226 bp, Homo sapiens
  misc_feature 92: r=a or g
  misc_feature 107: k=g or t
acatacccttcaggtttaggtctttcttaggtaaagttttaactttagtatatcttcctcagggcggccttctccttccccctagtaagtgragaaacccttgtgtktctgccctctgaactcaccgcatttgggattaccatgctaacatcctttttttcactgactgcaaattgccagagtgcaggaactatctcatttgctgctttctccctaatgcctggaa

SEQ ID NO: 33321 - DNA, 189 bp, Homo sapiens
taattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggtc

SEQ ID NO: 33322 - DNA, 272 bp, Homo sapiens
aaacagccaggccactcatcagagtccgggagccactggcagagagggcacggccccacactgccccagagacatataggagccaggcaaacaccagggcgagtgagctcgggccatctgctgcctgcctgtggaaggagcgctcgccagcctcacccagcccgagaaggtccacctctgcctccgccggagctgccctcattctggctccagtaagtgctgcttcttcctcctgggtttttttccactaccctattcagtaaccaggcctc

SEQ ID NO: 33323 - DNA, 303 bp, Homo sapiens
aatttatttgactgattattgcttctttccttgcattaaaggagatcttcccctaacctttgggccaatttactggccactaatttcgtttaaatacccattgtgtcattggggggaccgtctttacccctgctgacctcccacctatccgccctgcagcagaaccttggcggtttataggtaatgatggaacttagactcctcttcccagagtcacaagtagcctctgggatctgccaaaacacgtccactcccaagccactagcccactccccagttggcccttctgcccttaccccacac

SEQ ID NO: 33324 - DNA, 156 bp, Homo sapiens
  misc_feature 83: y=c or t
ttttatagctatcacaaatgagattgctttcttaattttttttcagattaatcatagttaacaaatagaaactattgattttygtatgttgatttcgtatcttgcaattttactaaaatgggttagcaattctaagagttttttggtgaaggcatc

SEQ ID NO: 33325 - DNA, 164 bp, Homo sapiens
tggagcctcgctctgatgcccaagctggagtgcagtggtgcaatctgggctcactgcaagctccacctccgggttcgtgctattcttctgcctcagcctcctgagtagctgggaatgcaggcactcaccaccacacctggctaattttttgtattttttttttt

SEQ ID NO: 33326 - DNA, 66 bp, Homo sapiens
  misc_feature 20: b=c or g or t
  misc_feature 33: s=g or c
  misc_feature 49: s=g or c
cactggtcttactaatcacbgtctttaccagtsagtacaaaaagttaasgcaactaggacaggtac

SEQ ID NO: 33327 - DNA, 123 bp, Homo sapiens
  misc_feature 108: k=g or t
cacaaatatcaagtaatttattttttccattttcaaatgcaaaagttagcctaggaagcctcccagtcatcctgaaggaccttttgactttgcttttataattctgtkaaaaattgaggaggg

SEQ ID NO: 33328 - DNA, 187 bp, Homo sapiens
catctccagaagtcatatttagtttttctttatatcattcatttctcttttaattatatacatgtttttctttaaatacttaaacatggttataacagctgtgttttaagctccttgtctgttaattccatcatctgtcatttttgcatctgtttttattgactaactttcttcctcatcatggtct

SEQ ID NO: 33329 - DNA, 69 bp, Homo sapiens
  misc_feature 4: r=a or g
  misc_feature 5: r=a or g
  misc_feature 32: k=g or t
  misc_feature 41: k=g or t
  misc_feature 61: k=g or t
acarraaaataaaactagtaatattgtatgtktatctatckctacatatttccagcatatktagcgtta

SEQ ID NO: 33330 - DNA, 151 bp, Homo sapiens
  misc_feature 122: w=a or t
tttcacagttagataatggagtcaaagtggtcctgcttcagttggacactagatataagtggcatgcttgttttcacttgtgaaagaaaagacagtggaaggacatgtacaatgaagtggawataccacaaggtatctaaaagagggggca

SEQ ID NO: 33331 - DNA, 303 bp, Homo sapiens
  misc_feature 62: w=a or t
  misc_feature 63: h=a or c or t
  misc_feature 192: d=a or g or t
  misc_feature 226: m=a or c
  misc_feature 245: m=a or c
  misc_feature 279: y=c or t
  misc_feature 280: m=a or c
tccaactggagtctgactccttggtttgtgtcttgcgcactctgcccaaagagagatgcagwhtcggggccacaggcattcagcgggagagtccagagaggggcaagatggaacaaagaccttgtaaggggaagagatgcctcctccccttgctcccctacactaagcagagactccatatcaatacgcaadgcaggtggacaaggtctgtgcccagatataggamacagagaaaacttggagamagagaagtcacagagaactaaaaatatgcatttymtcaaatattttaccagatcaact

SEQ ID NO: 33332 - DNA, 229 bp, Homo sapiens
ttaattttttttttattctttagtagagaccgggtttcaccacggtagtcagggtggtctcgatctcctgacctcgtgatccacccggcttggcctcccaaagtgctgggattacaggcatgagccaccgtgcccggcaggagcaccctactttttaaggagcaacccttttctccacactgcaccccaaccttagtcggcctgtgcccatttccctcactgctgcccc

SEQ ID NO: 33333 - DNA, 130 bp, Homo sapiens
  misc_feature 102: m=a or c
  misc_feature 106: k=g or t
  misc_feature 109: y=c or t
tgactggaaggctatggagctccagtggtagatgtggttataagggtaactggggggtctcagagtgggggccagtttgcatcaggcccctggaggtgggamcackgcytttcaaagagaaacaaagtgt

SEQ ID NO: 33334 - DNA, 219 bp, Homo sapiens
  misc_feature 96: y=c or t
  misc_feature 176: k=g or t
cagaaagtatgagagactggttcatatcaaagaatattgtgaaactctacactatatttgtgaagatatagaaaacccgttttatggctaaaaatyatcattttactactactaagcttcattattagtagatggagtttttttaaagggtcatttttcacaaagaaaaatttgtkttgtcttttaacactttaggactgttacttcatagtttatccg

SEQ ID NO: 33335 - DNA, 269 bp, Homo sapiens
  misc_feature 91: r=a or g
  misc_feature 92: w=a or t
  misc_feature 98: r=a or g
  misc_feature 99: r=a or g
  misc_feature 101: r=a or g
caaggctttattggatctacctacagatttaccaactttgctcaccattgcttctttaaaaaatggttctttttgtaccaaaagatatacrwtcacarrartgccatttttaaccattttaagtgtataattcacattaattacattcacgatgttgtgcaaccatcactgatatctacttccaaaactggaactcttgtgcactgcaaactttttcaccatcccaaacagataatctgaacccattaagcaataacctcccacccctc

SEQ ID NO: 33336 - DNA, 103 bp, Homo sapiens
cagctcaagtgtcctcatttccaggaagcattccatgaagcccctgctgaggtgaagctctttcccccttacgtctgtaatatttcgtgcaaacgtctgtcaa

SEQ ID NO: 33337 - DNA, 154 bp, Homo sapiens
  misc_feature 83: s=g or c
tagagaccccctactgaggctataggtagattgtgattagctggtgaggagaaggaataggaaatccctaggtgctgcggcasaaggaaggagaggggcgtttgctggtggtagtggtggtgagccatgactcaattcagttaaagggacctga

SEQ ID NO: 33338 - DNA, 189 bp, Homo sapiens
caataataactaatgagattaaaatttaaaacaggtgtctgataatccttgatgaagagaattcaggggatattgttcctgattttgctttctctccacttggaaaggaggtggacgagcccatcagaccacagcctgttgctaggaggaaattccttggctcaacatgcagaaagtgtagtacgccaa

SEQ ID NO: 33339 - DNA, 169 bp, Homo sapiens
tggttatagttgtacaactttgtgaatataccaacatccattgcattgtgtactgtcaacggtgaattttatggtgttttgtttgtttttgtttttcagacagagtctcactctgtcgcacaggctggagtggagtgcgatcttggctcactgcagcctccgcctccct

SEQ ID NO: 33340 - DNA, 169 bp, Homo sapiens
taggaatacgtaccactgcagagtgtgtgggtgtgtgtgtatgtgtttaaacaaatggtttcatgtagtacagattattctgcaaattgcttttctcacttaacattgtatctgggaaatctagccacacagtaggttttagaaaggatcgtcatttaaccaacccccc

SEQ ID NO: 33341 - DNA, 219 bp, Homo sapiens
ctgtaatcggtttttttttcttttcttttcttgctaatcctgtcaggctttagaattagttatcctcgtctcataaagtgagttacatagtaatcctaccctacccagtcctacccaatttttaaaatgtttgcgtaagattgttgttatttcttcttgaatgtttgacagaattcaccagtggcaccatctggtcctggaattttattttggggatgc

SEQ ID NO: 33342 - DNA, 190 bp, Homo sapiens
tatgaccatagtatagggaaataattcttttttttaaattaaatttttttatttccataggttattgggaaacaggtggtatttggttatatgagtaagttctttaatggtgatttgtgagattttggtgcactcatcccctgagcagtatacactgaacccaatttgtggtcttttatccctcaccccc

SEQ ID NO: 33343 - DNA, 61 bp, Homo sapiens
cctgcaaaatgtatactcgggttgtttttctttttaaaaatattgtaaaacaggcaagtga

SEQ ID NO: 33344 - DNA, 120 bp, Homo sapiens
  misc_feature 53: w=a or t
  misc_feature 56: k=g or t
  misc_feature 96: m=a or c
  misc_feature 100: k=g or t
ttatttattttgagacggagtcttgctctgtcacccaggctggagcgcagtgwtgkgatctcggctcactgcaacctctgcctcctggattcaggmaatkctcctgcctcagcctcccgt

SEQ ID NO: 33345 - DNA, 222 bp, Homo sapiens
taacaatttatctatattagcaaaaatatatacactatgaatcttagtccttttttgggaacagcatttgttgtgctttgtttccttttctcttagaacttttccttttgaagataaaattagaagacataccaatagaatatcattttatgtgtgcattgtctaatttttttcagataaaattggaatgttggcttctttgctttaattaccatagagaac

SEQ ID NO: 33346 - DNA, 158 bp, Homo sapiens
caattgtagcatgagatttctaagaaggcaggaggggaggggataagtatacaatatatgtataaatttaattttcagtttgcttggtatatataagtacatatagagattaatagctcccctaataaagagagggagagatggtgtagctgggacat

SEQ ID NO: 33347 - DNA, 113 bp, Homo sapiens
tgacatgcatagggtgtgtaatgatcaactcagggcatttatcatttccatatgtatttatcatttctatatgttctacatttcaagtccttttttttttttttttttttttt

SEQ ID NO: 33348 - DNA, 229 bp, Homo sapiens
cttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtaac

SEQ ID NO: 33349 - DNA, 105 bp, Homo sapiens
tatacatccagacactaatatagcatctgctgtggagtagccacataggaaatgtttcttaaagtgactgtgatttgtctctttttttttttttttttttttttt

SEQ ID NO: 33350 - DNA, 214 bp, Homo sapiens
  misc_feature 79: k=g or t
  misc_feature 80: k=g or t
  misc_feature 85: k=g or t
  misc_feature 86: k=g or t
catatatattagggtttatttctggactctgtattgtatttcacaggtctatgtgccttttagacttttatttttattkktattkkattttattttattttttgagatggagtttcactcttgttgcccaggctggagtgcaatggcgccatctcggctcaccacaacctctgcctcccaggttcaagtgattctcctgcttcaccctgcccat

SEQ ID NO: 33351 - DNA, 135 bp, Homo sapiens
  misc_feature 11: m=a or c
acttcctgggmccggctggcactgccctgcgccgccgcccgtcagtcccggtaccccgccaggaaatgtcttcttcctgggaagacggccgctgtctgcggcagtgggtggcagagtctgaaaccaagtcgcttt

SEQ ID NO: 33352 - DNA, 316 bp, Homo sapiens
cagtcaaatgtgttgttgaagaatgattgctcactatagtgaagattggattggtggtcagcccttatcataggctcaagtacatagtagggatatgtatatgacgtaaaattatacttaaccctctttcattcaagattttgagtttgtaggtgttgtgctgaatagagtcctagaatgtagcagttcgtggttggtttctcacttgtttgagctcttttctctttattgcctgtttcagaatgattaaaccagaatttagctatctgtggcacagatgtttggttacatacatgagacactagcactatgtcct

SEQ ID NO: 33353 - DNA, 128 bp, Homo sapiens
tgtatttttagtagagacggagtttcaccatgttggccatgatggtctcgaactcctgacctcaagtgatccacctgccttggcctcccaaagtgctgagattataggtgtgaaccactgcacccggc

SEQ ID NO: 33354 - DNA, 245 bp, Homo sapiens
aggaattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctaa

SEQ ID NO: 33355 - DNA, 244 bp, Homo sapiens
cttactactaaatttattaccaagagcaattttatgacggagcctgagaccttattataaatattcttcctcttcttaggtcaattctgtggttgatttaccttatcatttacatttaccacttaacagaattttttaaaaacctttttatttataagttcatgttccagaaacacaattgtgtctaatattaataacagggtggaaaaaattaccaacaaccctgcaactttatatgcaagga

SEQ ID NO: 33356 - DNA, 142 bp, Homo sapiens
atcttgttaataattcctctagatagaataatgtagaaacattttatttgtggactacagcttattcagcctgggaaaaataatgttggagaaatactctatgaatagaatatactttggaagcccttaactaaacgcttac

SEQ ID NO: 33357 - DNA, 90 bp, Homo sapiens
agcattccttccttctgagtacggggcaggactctctctgggatggaggggtcttaggacctgcaagcaaacaagactcagcccacaact

SEQ ID NO: 33358 - DNA, 286 bp, Homo sapiens
  misc_feature 18: m=a or c
aatgattagaccttaggmagtgccagtgggttggtcctttcatgaacatgccatcagtaaaagccctggaaacaaggtcataccagagattcattgtgccttgtcacaactgcaaacaatatctgagtggaatattcaaaaacttgcttagaaagaaaactctaggacagatggctccactgaagttattccaaatatttaataaataaagcataccaggcttttataaactcttctagaagaaaaaagttggaacttttccaattcagtttttcaggccagtgcg

SEQ ID NO: 33359 - DNA, 440 bp, Homo sapiens
  misc_feature 29: r=a or g
  misc_feature 30: d=a or g or t
  misc_feature 108: k=g or t
  misc_feature 127: k=g or t
  misc_feature 130: w=a or t
  misc_feature 305: b=c or g or t
  misc_feature 408: r=a or g
ttagacttgcctgggcgctggcattgagrdgaatatcccagctacctgatgtgacagctctagcagaattcacagaggcagatgaagcaatggcagaactcgcaatckctgacaacgttttcctgtkctwcatggaatctgtagtggtatcagaatacttttatcaggaagaattttatattcgcagagtccataatctcatcacagatttccttgcacttatgccaatgaagatggagtcttgctctattgcgcccaggctggagtgcagtggtgtgatcttggctcactgcaatttccgcctbctgggtgaaacagctgaggaatcgggcagatgaagatgctcgaatgattcacatgagtatgcagatgggtaatgaacccccgtttcacttagaagggcctggracacttaatgcttttgattggcgagctatata

SEQ ID NO: 33360 - DNA, 275 bp, Homo sapiens
ctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttttggtatctatctgaagcacagatgctcaccacctccgcagctgtgagcagcctgcctcgctgggaac

SEQ ID NO: 33361 - DNA, 303 bp, Homo sapiens
cttgcattcagacatgactgaacatttcctagttgtggcccaggagctctcaatctggttgggacagatctgcaaacagataaatgtctcatagtttgatgaggggaagaataggcaccatggagttatgctgatcatctctgtgaggccaaggaagcttgagagtcaaggagcacttgagctggtgttggaagctgagtgggcatggccccatgggaacagcacaggaaaccacactttgctgaagaacttcttgtgcagagctgcaaaggcatgaaagagtcttcgacatttagagtgcca

SEQ ID NO: 33362 - DNA, 152 bp, Homo sapiens
ttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctcga

SEQ ID NO: 33363 - DNA, 71 bp, Homo sapiens
ttctgtgccttactttggccaccactggctttggctgactgtgacactgactccacacacaacatacgagc

SEQ ID NO: 33364 - DNA, 271 bp, Homo sapiens
  misc_feature 175: r=a or g
  misc_feature 218: r=a or g
  misc_feature 219: w=a or t
tattgtctgagtttctcagctgactgaaaaagggaaccctgggaacacagcctctttttagtaaaattgtttttttcttttttaattgccatataattcacaattcgtgtaccataaaatcatgaaatgctctcttttaaagtgtacaatatagtggtttttaaaatattcagartattgtatatctatcaccactatcttattccagaacattttgrwtcagccaagaaattaatcccatacccactggcagtctcttcccattccccct

SEQ ID NO: 33365 - DNA, 195 bp, Homo sapiens
ttcgtgtttgtttgtttgagaaggagtctcactctgttgcccaggctggagtgcagtggcacgatcctggctcactgcaacctctgcttcccaggttcaagcgattcttgtgcctcagcctcccgagtagctgggattacatgcatgtaccaccatgcctagctaatttttatatttttagttgagacggggttc

SEQ ID NO: 33366 - DNA, 177 bp, Homo sapiens
taactgggtttcttccatagtcacttaatgcagtaatttctggtagtcgttcttattcattcattcatttagtcattaattcagtcattgatcaaatgttatcagatccctcattctgcaccaagtcctcagctaagattagggacgaagataggaataagaccccatccccacaca

SEQ ID NO: 33367 - DNA, 462 bp, Homo sapiens
  misc_feature 333: s=g or c
  misc_feature 340: y=c or t
  misc_feature 341: s=g or c
  misc_feature 389: n=a, g, c or t
gagttaagaattctggaatattttatctagtctagggcatatgcgactagctttgcagcctttgagaaactttttattaagtcaaacacaggaaatgtaggttaagactgtggtcaccaatataaaataaaagggtactttttggtgtatattggttggagtttcaagcagtacctccctttatatctgtttggttgactttttccagtgattggtgaattgtgactgtcattgaccatttgcttctcattgtaagaatgtaaaggttaagttactatggctttttttggcttcaaacctatgttaataaatgaaatgaaagtcttgttgagstttattysgcagagggaaataagttactttttagctgtcttagtttttcatttgtngccgtatgacccagtatgccacaaatagcgtggccaactgctgcagagtaactaggatatctgaatgtgagac

SEQ ID NO: 33368 - DNA, 137 bp, Homo sapiens
  misc_feature 91: r=a or g
caaaaaattagtggggcgtggtctcaggctcctgcagtcccagctacttgggaggctgaggcaggagaatggtgtgaacctgtgaggtggrgctttgcagtgagccaagatcgcgccattgcactccaacctggaca

SEQ ID NO: 33369 - DNA, 371 bp, Homo sapiens
  misc_feature 4: k=g or t
  misc_feature 89: r=a or g
  misc_feature 361: s=g or c
agtkgttgctcgcctcgggtcgcaactgcgtagaggcttcgcgcctttctcagatactgaggaggcttgaacctgtgggtgggaggtgragcggaaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggaggtctcgtggcggcgcgtgttgggtctgcgtttcccctctggggtgcttgggcagcatgagcccagggctgtggacagcctggtgctsacgggtttgt

SEQ ID NO: 33370 - DNA, 267 bp, Homo sapiens
  misc_feature 194: r=a or g
gaccccgtctctacaaaagaaaaattagctgggcatgtggcacctgcctgtggtcccagctactcgggaggctgtgaggcaggagaattgcttgggcctgggaggttgaggctgcagtgagccgcgatcacaccactgcatgccagcctgggcgacagagtgagaccctgtctcagaaaagaaaaaaaaagtaraaattgcatgtaagttgacccgcactattcaaatttgtggtgttcaaggttcaactgtaatttcctagcaact

SEQ ID NO: 33371 - DNA, 255 bp, Homo sapiens
catagaagtgagttatatctttggttgagtttttaaacattcattcttactggggtagtatttgggaaacattgtatcaggttttgctggtagagaaagggtaaatcagtaagttaaagaataagtgatatataaggatttaaaaaagaaggcctcaagtttaaaggatatatgtaattacaagatgatctcaattttaaatcagaacacttaagttggatgtataggagacaggaaatgcatgttagagaggca

SEQ ID NO: 33372 - DNA, 342 bp, Homo sapiens
taattaaattattgtatatggagatgacaggtagtggattgattattctcctgtagataaccatttgtccctgctttttctgttaagtgttcaccacttgtatcattggctggcaatacctggtttgtcatagtttcacattaccttaaacagatgcccagactgggcacagtggctcatgcctttaatcctagcactttgggaggctgaggcgggtggagcacctgagatcaggagttcgagatcagcctgaccaatatggtgaaaccctgtctctactaagaatacaaaattagccaagcgtggtggtacatggctgtaatcccagctactcaggaggca

SEQ ID NO: 33373 - DNA, 382 bp, Homo sapiens
  misc_feature 303: k=g or t
  misc_feature 319: k=g or t
  misc_feature 320: h=a or c or t
  misc_feature 321: s=g or c
  misc_feature 326: b=c or g or t
  misc_feature 331: y=c or t
  misc_feature 343: d=a or g or t
  misc_feature 350: w=a or t
  misc_feature 351: k=g or t
  misc_feature 352: n=a, g, c or t
  misc_feature 362: r=a or g
ttaagtccttgttgcagtagctggaggaagtgagcttggaaatctctccagcgcaatggttgctggctgggaagaaagatctgacttagacacagaataagctgcttgtgctgggtgtgtttgtgagctgggtgaggttttctgtgtcgctgggcacgtgagggaagttacgtggctggggggtggggtggggggcattagaagggagtatgggtgtctgtgggcgctcgcgtgtgcgtgtatgtgtgtgtgtgtgtgtgagagagagagagagaaggtaaaattaactttgtcctatatgtkggtttctctgctagakhsttaabgactygagctgcatttdtattgtwknaattacagcratctctctaggattgttggt

SEQ ID NO: 33374 - DNA, 274 bp, Homo sapiens
  misc_feature 260: n=a, g, c or t
aactatgacagttctcagcctggagttcacattggaatcacctggggaggttttaagctgctagatgaatgggcccacctagaagcttattaaaatacagtgtgagccccactgtgagtatgattctggaagagctaaagatgtaccacgattccagcctaatatttaggttctagttttaatatgcttcttaagctactaaaatattttaaaaagattgtagattctattaattgactttgttactaggttttcatctnttaacatgccaata

SEQ ID NO: 33375 - DNA, 251 bp, Homo sapiens
tcctatggctaaattctctccctctgtccactgcttacacatgggcatttcacaatgtcctttttccctgaaggaacttaccccctcccctcagccttaagtaccccatctgtggggatgatgcccatgcctgtagtcctgactcactcaccacgctctatcgcagttatttactgatgcatctctctcccctatcagacgctgaggtctttgatggagcaaccttgtatttgtccgtgtatccccggcct

SEQ ID NO: 33376 - DNA, 334 bp, Homo sapiens
taaaatctggtgtgtgcaactcccagaaacccacttgtcttcttcgttgtcttgtgctagccacattggcttccttggctttccataatctttttagatctttgacttggtgttccctctaactgtaatgctcttcctccagatagccacattattcctgtgattcctttgtcaagactgtcttcaaatcaaatggtattttttcaaggaggcctaccttgatccccctattttaaattgtatcttacatcccttttctctctgtcctcctttctgtcactgcccccgaccctactccagtactattgtttattgtctttctctcccactaaga

SEQ ID NO: 33377 - DNA, 133 bp, Homo sapiens
taaaaaccaattttcaaaaagtagccgataatattaaaacatgttttctgccattatttttcaaaccaatcagcattttgcaaatgaaggtttctagacagcattagttacaaggctttgtgtttttcttttt

SEQ ID NO: 33378 - DNA, 226 bp, Homo sapiens
tggaaactggaaagaccattgagacgtaaaacagtgaaaagtggcttgccagcaaaactgattgagtacctgacagcacatctggttttgctgctttggtgaagggagaagctccacgagccactatgaatcattgcttttacattggcatcaaagactctgccaaagatcgtgaaagaagtcttgtctaaggtctctaaagtcacattttaacctagtcaggcgc

SEQ ID NO: 33379 - DNA, 257 bp, Homo sapiens
ttattaaataagattaaaatcttccattgggaatctattttaaatcactataaaacttacccataaaatgtcaatccgcaacgtgaaacaggcagaataaaaattgttttcgttcactttacactaatataaacttattttcagtaaatgttccagaacaatgcaccattttatacctcccttacttataaagatattttttaaaaacctccctttcctataaaaatatttttaaaatacaccatttacacgctccc

SEQ ID NO: 33380 - DNA, 168 bp, Homo sapiens
cacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaacgc

SEQ ID NO: 33381 - DNA, 215 bp, Homo sapiens
atgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgc

SEQ ID NO: 33382 - DNA, 150 bp, Homo sapiens
cgttctcctgcctcagcctctcaggtagctgggactataggcgcgcaccaccacacctggctaatttttgtattttttttagtagagacagtgtttcaccatgttggccaggctggtctcaaacacctgacctcagatgatctgcccact

SEQ ID NO: 33383 - DNA, 361 bp, Homo sapiens
  misc_feature 295: h=a or c or t
tttctattttatgcctgcaattaggcattggtcaggggtgaatggctcttttcacagagagtagccaaccagagacctttgctttgatatcatcaactgcagacaatgctgttgatggggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaagahtctaaaactcttgttcacatgctattatgacttataaagcagcaacagctgaggcgcaccagggcc

SEQ ID NO: 33384 - DNA, 285 bp, Homo sapiens
agaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgttgtatgccagtgactcatctggagtaatctcaacaacgagttaccaatacttgctcttgattgataaacagaatggggttttggatcttagcaattctcacaattctcatgtattccacagcagcc

SEQ ID NO: 33385 - DNA, 330 bp, Homo sapiens
tgtttgttcattagaatggagttgtatgtatccagagggtaatattcccataggcataaaatgttaagaagactgactcatacctggaatttggaaaggtagccttcccagatattttgggaacttctttgttgagagagagagagagagatgcccaatgtgacagcacattgggcatcaggcatatggctgatcctggggccgcagggaccatgaaaagacacaggatttgggttcaatcatgagagaaagggaatcctttccctagcttcttacacagagaatctgtaggacctgctggaatcactagttggttttgtttcccaagaa

SEQ ID NO: 33386 - DNA, 167 bp, Homo sapiens
ctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaaggggcgc

SEQ ID NO: 33387 - DNA, 156 bp, Homo sapiens
cagtaaaacaggcctgctttcacaaaagcaaaggaaacgcaacactagcaacctcccaaaatataaatggatatccaaggaccaccagacgaatgaggtgaaccagaagcatgaaagaaaaaaggccaagataaatagaaaaactaaccccagtgc

SEQ ID NO: 33388 - DNA, 174 bp, Homo sapiens
  misc_feature 84: b=c or g or t
  misc_feature 85: m=a or c
acaaagtttccggttcagtctcgtgggtttcatgtactcagccagcatttacttgccagtcaaggtctaggatggctacctgtbmtctgcaggagccccaagcctattcattaatttcatttacaattttatagtcataattatttctttgtataatagcattctgagacttta

SEQ ID NO: 33389 - DNA, 188 bp, Homo sapiens
  misc_feature 8: m=a or c
tgtatggmattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgagacc

SEQ ID NO: 33390 - DNA, 289 bp, Homo sapiens
tttagtcatctaagaacatactgttggcctgagaaataaacaagtccttgcacattacataataaacagtattcttattgaatataaaagaatgtagttctgtataatatttttgagaaaaacgacgcactgataaaaaggttagttggtttggccatgtgaaagtttaaacttggttgggttcggtggttcatacctgtaatcccagtattttggaaggctgaggcaggaggattgcttgatcccaggaatttcaagatcagcctgggccacatagggagacccccac

SEQ ID NO: 33391 - DNA, 286 bp, Homo sapiens
  misc_feature 28: r=a or g
gaaaggctgccggtgtctgctgcctgaratcaaaatagtgggtcatctcccttctcttgccggcccagctaacctctgcaccaatatttggagaagacaccctttgaggtgacccaggttgtcttgttggacacaagcaggccccaaactgccatgaaagccctccaaccccactctccgcagtttggcaacctggcctcagtcctcttagattcggcagcagtcaccagattacccaggtacccaggtatttgagatgcggatgctaaagccgaactctgtccgc

SEQ ID NO: 33392 - DNA, 266 bp, Homo sapiens
  misc_feature 7: y=c or t
tgtgttycttgagcctaatgtgttccagaacttcctatttccttaccagttctctgatttaaagaaattgtttattttttcttcactttttcaacaatctcactttttcaacagtctttattgagcacctgtgcctatgtggagattaaacacattgcggggcattgaagaacagtgttggggtggtattagcacaacactggttctagggagctcagggagtgagcacttatctctgcctgagtgggcttcctggaggaggtgca

SEQ ID NO: 33393 - DNA, 200 bp, Homo sapiens
  misc_feature 13: d=a or g or t
  misc_feature 14: k=g or t
cagatgcttgtcdkatttttttaaccttccgtgatcacaaacaggaatataggcctttgaatctgaagtggacaaaggaaagcaatttccagtctggctggggcacagcattaggtgattgaaaaggtgatgtggacttgtaaaaggtgttactcaaatattgaaggaagagaatttcctccttgtgatacttaggacga

SEQ ID NO: 33394 - DNA, 64 bp, Homo sapiens
agggtaggaatgcgctgcgggcgggcggcgcaggaggcgagcggcggaacatgtaagggcacaa

SEQ ID NO: 33395 - DNA, 219 bp, Homo sapiens
atggggtgaggtggacagaaattaagatgcagagcccacccaacatgtggacatgtaaagtcttatgagatattcttgcctaattaggcttgggctccatatatctacagctgagaggtaaggatgaaccagaactaaccgcttttcatcacctacctcccaatcaaatatcaaggaatttcaagacaagttgtgttggtactgagcagagcaggaacg

SEQ ID NO: 33396 - DNA, 143 bp, Homo sapiens
tgaatgaatgttgaattttattaaatgcagtttctgtaaatattaacgtgatcatattatttttattctttcatttacataattataaattagattaagttttcaatgttaagctacccttgcatttatgaaataaaccacgc

SEQ ID NO: 33397 - DNA, 283 bp, Homo sapiens
  misc_feature 26: h=a or c or t
  misc_feature 28: d=a or g or t
  misc_feature 109: b=c or g or t
  misc_feature 110: m=a or c
  misc_feature 128: k=g or t
tcacacactcacacactctgctcachcdctcaagttcttgcctccttgcttttgctcagagttccctctgttatgattcctcctgttggcccccttcttccagccctgbmagtagcttctatccagcktgagactcagcttcttggccaggcagggtggctcccgcctgtggtcccagcactttgggaggcggaggaggaaggatcacttgagtccagaagtttgagactagcctgggcaacagagcaagacccgtctctacaaaaaataaaatagccaggca

SEQ ID NO: 33398 - DNA, 235 bp, Homo sapiens
  misc_feature 95: s=g or c
  misc_feature 193: y=c or t
agaaataaattaggcagatctatgaaatagcaggaaatactaaccatttgagtgcaaaagtattcgtgtacattaatttctgtttttagggttgscccatatcttctagcatgagtgttaaggagaaaagaatgattataaatgatcaatgtcaaaatatgattcttgaagatacaataagtttaaatttttytttcttaatagagttgttaaggcaaatgactttgggaagatg

SEQ ID NO: 33399 - DNA, 149 bp, Homo sapiens
tggaacatttgtttcttttcttttttaaggagaaaaaaaaaatgagtaaaaggagctccacactttgacttaatttcatacaaagctctgatgacaggccatgactgtagagtggtcagaactgtgtggttggtttgagggagcgaatt

SEQ ID NO: 33400 - DNA, 168 bp, Homo sapiens
tattttcatgtacttttatatattcggggagaattttgcaaatgttatgcgtaaaattaattccattatcagaagtaaataactacttcaacttatttgacctttactcttaacaaagtgccatgagatgatggtgattatcaaatcctgttgttttataaagccctt

SEQ ID NO: 33401 - DNA, 168 bp, Homo sapiens
caaaggaaaaattggtggaaggatggtcgttttcagtctgaatgggttggtccttgtgtcatagactatattacagaaagtggatgtgctgtcctgagagacaacactggggttagactgaaaagacctatcaaaatgtcccaccttaagccctacataagagaatcc

SEQ ID NO: 33402 - DNA, 321 bp, Homo sapiens
  misc_feature 141: v=a or c or g
  misc_feature 142: m=a or c
  misc_feature 304: r=a or g
tatggttttgtttagctacatgcatccacatcatgaacatactttcatatctttaattagaacttttgagtgtttgcaaagtgttacactaatgagcatttcagtttaactagttccttattgtttgactctcgggatggvmgcacacttgtgttctgaacatacttgtaactgagtcttgacatacattctaaatcatttcttaggatgatatcaagtacagtgtaaagagtggtgaaaaataacaaaatgggcactaggagaattagatgtaagttttaactttgcctttaattgttgctgraacttttaaatcacttt

SEQ ID NO: 33403 - DNA, 154 bp, Homo sapiens
caggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccaccca

SEQ ID NO: 33404 - DNA, 170 bp, Homo sapiens
  misc_feature 98: r=a or g
  misc_feature 99: m=a or c
  misc_feature 127: r=a or g
tctaacacctaaaaaatggaaacaagccaaatgctcatccactggtaaatggataaacaaactgtagtctttctatacactggaatatttggctatarmaaagaatgaaatattgatacatgctacracattgatgaacttcaaaaacatgctaagagaaagccagtctg

SEQ ID NO: 33405 - DNA, 153 bp, Homo sapiens
  misc_feature 119: s=g or c
agtagccgcttcagggagggacgaagagacccagcaacccacagagttgagaaatttgactggcattcaagctgtccaatcaatagctgccgctgaagggtggggctggatggcgtaastacagctgaaggaagaacgtgagcacgaggctct

SEQ ID NO: 33406 - DNA, 152 bp, Homo sapiens
ttgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggagg

SEQ ID NO: 33407 - DNA, 161 bp, Homo sapiens
attgaattttaagtagtagatatttgactgtttcccttttgtagggaagattgtaggattaatctttcaaactaccctgaatctcaaacaaatgatctctgaagatctgaagtgtgtgtgtgtgcatgtgtgtgtgtgtgttgaagtcgagtcacctaccg

SEQ ID NO: 33408 - DNA, 89 bp, Homo sapiens
  misc_feature 11: r=a or g
  misc_feature 25: m=a or c
  misc_feature 27: m=a or c
  misc_feature 28: w=a or t
  misc_feature 64: r=a or g
  misc_feature 65: r=a or g
  misc_feature 73: r=a or g
tataggtcaaraatatgaagaatamamwaggaccttctttcctactgaattatatttatttcarraagccttrgatccacatagcttta

SEQ ID NO: 33409 - DNA, 171 bp, Homo sapiens
  misc_feature 34: k=g or t
  misc_feature 45: r=a or g
  misc_feature 128: m=a or c
  misc_feature 144: r=a or g
  misc_feature 149: s=g or c
  misc_feature 152: k=g or t
ataccattaatatatttatttgcattaccctatkatatacatatraatgtttttaaaattatgatgtcgtattatgaccatcactaaacagtagtttaagatgtcacagcacttttttttttcctcamtctgtcacccaggttrgagtscaktggcaagattatggcttac

SEQ ID NO: 33410 - DNA, 117 bp, Homo sapiens
  misc_feature 99: k=g or t
gaacagcgttgtctttctgtgatggtggacgtgctgtatatctgcactgtccagtaccatagctcccagccacatgtggctattgagcattgaatatgktcagtgtggccaaggaac

SEQ ID NO: 33411 - DNA, 112 bp, Homo sapiens
tgtgtattttaattaatttgtccacttaacctcagcagttaaatttgttggcataatgttcataatattcccaaatttctttaaaagtgtgtatatttctctagtggtgcct

SEQ ID NO: 33412 - DNA, 74 bp, Homo sapiens
  misc_feature 55: s=g or c
catagttgtgagttattggatgacataataaagcccagcccatgcccggctaatsttttttttttttttttttt

SEQ ID NO: 33413 - DNA, 367 bp, Homo sapiens
  misc_feature 102: s=g or c
  misc_feature 107: m=a or c
  misc_feature 121: s=g or c
  misc_feature 287: r=a or g
  misc_feature 288: n=a, g, c or t
  misc_feature 289: n=a, g, c or t
aggaaaggcgaggctctgcatctagatttacctcgttctcttttgtctccgctttcttttcacatttccttgcgaccctggcccttgagcgacaaaaagggsaagcmaaggctggcccgasgaacggagagggcacatggcctagccacaagtggagcttctgctccgcccgaaggatgcgctggagcggcctcttccttctgccacggtctttctttgccaactagtaggttagccaggctggtcttgaactccagacctcaagggatccgcctgcctcagctttrnnaagtgctgggattacaggtggagactggacctcagaagagggagtgggtgccccgagaactcacagctagcggacagt

SEQ ID NO: 33414 - DNA, 197 bp, Homo sapiens
tttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacc

SEQ ID NO: 33415 - DNA, 312 bp, Homo sapiens
  misc_feature 86: s=g or c
  misc_feature 87: m=a or c
aagatgagaaggagaaggaaaaggaggcggagaaggaggaggagaagccggaggtggagaacgacaaggaagacctcctcaaggasmagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagcca

SEQ ID NO: 33416 - DNA, 210 bp, Homo sapiens
atactaaataaagaaaaacaaggtaatacataggcctgtcagttcagagaagattttgcctctaaatgagttacaaatacttttggatttagattcttggggatttcagaattgtatataaagaattgtgtatctgtgttgttgtaagtgtatgcttctgggaaactatagtttctgtttggagaggaataaaagattaaggagacaaaa

SEQ ID NO: 33417 - DNA, 151 bp, Homo sapiens
atggatcagggtgacgggtgtgtgtgcactgattatgtggggccttgtaggccatggcaaggactttgggcttttactaagcaaggtggggagccatttgagggattttaacagatgaatgatgtaacataacttaattttaggaggagcg

SEQ ID NO: 33418 - DNA, 167 bp, Homo sapiens
atatgaaattgaaagtagttttttctaattctctgaagaaagtcaatggtagcttgatggggatagcattgaatctataaatcactttgggtagtatggccattttcacgatattgattctaatgtagacgacaggttggtgagtgcagcaaaccaccatggcagca

SEQ ID NO: 33419 - DNA, 222 bp, Homo sapiens
caaagaaatcaagaaatacactcataaaacaagacatggtcccaatcattttgagaaagtttatggtgggtaaaactgaactggacagataattaatgtcatacaacaacaacagtgcccacaggaaagttccatttaaacaataaaacaagccacataatattttcatagtacctcagaacagaaattggttgtgtggcttaagcaaattcaaaggctgca

SEQ ID NO: 33420 - DNA, 311 bp, Homo sapiens
agtgtattaaagatgaaaacaagaaaaccgaatatattgaaaggagcagagaggcaatgaaaacaagacaactgaaatgaggactttgccaaaagcttcaagaagtagccaacataactcaacatccaaaatgtctcctgccatttcccttaacactacagcctcagctggcacgtgattggaatctcaaggcatgacaagcaagagtccaacgcaaatgtcttgccgccacccagcaagtgttacagacatccagcctattctagctggaccctcactgctctctgccctgccacctcaactcagccctc

SEQ ID NO: 33421 - DNA, 109 bp, Homo sapiens
ttacaggcatgagctaccgtgcccagcaggtctttaatgatttaagatcaaatagtaccaaagactttatcgtgagaaatagaagttacctgccccacgactcccccct

SEQ ID NO: 33422 - DNA, 217 bp, Homo sapiens
ataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgccttca

SEQ ID NO: 33423 - DNA, 265 bp, Homo sapiens
  misc_feature 2: b=c or g or t
tbatacaggctgaaacagtcatttgacctgttcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccaa

SEQ ID NO: 33424 - DNA, 83 bp, Homo sapiens
ttccttctttctccctccgcctcccgagcaccagcgcgctctgagctgcccccagggtccctcccccgccgccagcagccctt

SEQ ID NO: 33425 - DNA, 197 bp, Homo sapiens
taatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtag

SEQ ID NO: 33426 - DNA, 170 bp, Homo sapiens
attatatcccagggtaagactcccacttagcgctccccgcttgctgctgggagtaggggtatagggtggaggaattaagctgcttagagcatggggccaagcggacaggttggtttgggaggctgaggtctctatggtggtggatggaaaaggagaagcaagggacctgt

SEQ ID NO: 33427 - DNA, 104 bp, Homo sapiens
gaatcagaaagcggtggattctggcaaatggtccttgtgccctccccactcatccctggtctggtcccctgttgcccatagccctttaccctgagcgccacccc

SEQ ID NO: 33428 - DNA, 166 bp, Homo sapiens
tagtaggatccaagattaaactcaaaatagtatttaaattgagcttttattttttttgagacggagtttcgctcttgttgcccaggctggagtgcaatggcgtgatctcagcttaccgcaacctccgcctcctgggttcaagcgattctcctgcctcagcaggaga

SEQ ID NO: 33429 - DNA, 335 bp, Homo sapiens
  misc_feature 335: k=g or t
tgaagctgtggggtacatgattggtgcacaaacagatcaaacattacaagaacacttgatagaaaagtacatgttactccctaatcaagtgtgggatagtataatccagcaggcaaccaaaaatgtggatatactgaaagttggccaggtgcagtggcacatgcttaatttcagcactttgggaggccaaggtgggtggattgcttaagcccaggagtttgagactggcctggacaacatggcaaaaccctgactctactaaaaacacaacatttagcagggcatggtggtgtgtgcctgtgggcccagctactatagaaactgaggtaggagtk

SEQ ID NO: 33430 - DNA, 126 bp, Homo sapiens
ttttagtagagacagggtctggttgtgttacccaggttggtcttgaactccagagctcatgtaatccacctgcctcagcctctcaaagtcctgggagtacagccatgagccaccatccccagcata

SEQ ID NO: 33431 - DNA, 148 bp, Homo sapiens
tttggggcagttttttcctttaattatttttttcaatttcaagtttaattttattttagctgatctgatgtggtttcaactaacccaaggtctcaccatgttaaaatgccggcggactctacggcgttttgtagatcccccccccccc

SEQ ID NO: 33432 - DNA, 388 bp, Homo sapiens
  misc_feature 7: w=a or t
  misc_feature 328: k=g or t
  misc_feature 329: r=a or g
ttctttwtagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggacckrtaaacggttcccagttgtctgagagcctcatgagggtttctaggatttatgacctatag

SEQ ID NO: 33433 - DNA, 154 bp, Homo sapiens
  misc_feature 29: n=a, g, c or t
  misc_feature 108: k=g or t
  misc_feature 109: r=a or g
ctcactgaagctgacctccgcgttaaccntggacacaagccgagcaggaaggataatgccggcttgacaactccactggtttctgctcccactggccctacctctgtkrgaggtgttcgccaggcaccccatgcggtcaccagcagacagccca

SEQ ID NO: 33434 - DNA, 59 bp, Homo sapiens
ttctctgttgtatgttggattatgtaggaaatgtttgtgtacaattcaaaaaaaaaaaa

SEQ ID NO: 33435 - DNA, 319 bp, Homo sapiens
  misc_feature 46: s=g or c
  misc_feature 291: w=a or t
  misc_feature 292: n=a, g, c or t
  misc_feature 310: h=a or c or t
  misc_feature 311: h=a or c or t
  misc_feature 312: h=a or c or t
aagaaaggctcttcctgggaagctgagaaggggcatgcacagcgtscagatgggtgtacagtggagagggccagctgacatattgagcagaggaccaaaatcgatgatctccttggctggtggcttaccaaatccaaacatgtttccttttagactgccgtaatcactgtagaaaatggaaagaccatccaatttggagaagagatgatgaagagagcacttcagtattctccgagtgctggaattccagagcttttgtcctggctaaaacagttacaaataaaattgcawnatcctcctaccatccaghhhaaaccca

SEQ ID NO: 33436 - DNA, 216 bp, Homo sapiens
cataaactaagaactgagagcggaaaactggaatttgaacctaaacaattaggcccttttactttccccagcatctactttccctttgttttggtctaaaaacagtctgtctgtatgtctataaataaattaacacctggtctttctttgatagtggagaactagaaagtactgtaggtctaatattgtcaaagtgagaccttgtctgtgggccgc

SEQ ID NO: 33437 - DNA, 154 bp, Homo sapiens
atatgataaaatctctaccagtaaagctcaagtttgattgcagtagagattgattagggtacagaaagacaagtaaacaaatgattacatgcatggttagggcagcagtagagctatacaaaatacgtgtagtaaaaactacagagaagggatc

SEQ ID NO: 33438 - DNA, 105 bp, Homo sapiens
taattattaaatttctgatcatgtgaaggtcatgtagtaaggcctgaatgatatatttattagttttttaaatagccaggtagttttatgtatttattatgtgca

SEQ ID NO: 33439 - DNA, 106 bp, Homo sapiens
cagctttggacggacagccgtgaacgctcagtcgggggtgtgcaccccggcggggggcctggtgacgggagtgctggtgctgctgtctctggactacctgacgaaa

SEQ ID NO: 33440 - DNA, 245 bp, Homo sapiens
ttcacaaatgtattagactgacatacatacctcaaatagagttgactgcttgtgaggaatgggggaaaatatgagaaattttaatttattttcttttcagtaaattacttgcaaagtaattttattagttttatttattattattattattaccatttgtttttttgagacagattcttgctgtgttgcccagactgaagtgcagtggcatcatcttggctcagtgcagcctccaccacccaggc

SEQ ID NO: 33441 - DNA, 204 bp, Homo sapiens
tatgtttgtgatggaagggagcagaggttggagctggcactgccagtggggactttagtcctaaagcaaagcaaaatgttcttctaaaacagtagggctcgatccctgagttccagaaactggtggcaccactggatttgacctttagagatttaccaggctgcatgtgtggtggatggtggacagaggatgggggcgaggcag

SEQ ID NO: 33442 - DNA, 389 bp, Homo sapiens
  misc_feature 91: d=a or g or t
  misc_feature 94: s=g or c
  misc_feature 97: w=a or t
tttttctatggatcacgtttctttgtatatttagtgatttttgattgaatattggactttgtggctaatatatagagactctggagtctgdtasctwtcattgaaaagtggatatttttgttttagtaggcagtttatttactggttgccaccttaattttaggcttgactttatgttttgttaatgtgaatctctgaaagtgtaatatgtttcttttagccttccagctctgttttccttgtggatcttttgtggactttgttggcctgatcctattctccctttaatactactgactctctgttatctcttctatgctcttaaccctgtagtagcttgatatatagagtgatctttccctgctgttacacaacttggccttagctgt

SEQ ID NO: 33443 - DNA, 152 bp, Homo sapiens
ttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcac

SEQ ID NO: 33444 - DNA, 118 bp, Homo sapiens
aaatgatattttagagtgctgatcctcattttctcttcggtaaagaacacaacacgattatttgtatttatcttgtcgtacacacactcaggattactcactgaggaatggggcgcgg

SEQ ID NO: 33445 - DNA, 192 bp, Homo sapiens
  misc_feature 52: s=g or c
  misc_feature 53: k=g or t
  misc_feature 104: s=g or c
  misc_feature 107: s=g or c
  misc_feature 110: s=g or c
  misc_feature 111: s=g or c
  misc_feature 139: s=g or c
  misc_feature 140: s=g or c
  misc_feature 148: s=g or c
  misc_feature 149: s=g or c
  misc_feature 150: s=g or c
gaagatccggactctgggtgttttgctaccgtgaccgtttagaaacagagtskcgctctgtcgcccaggctggagtgcagtgtggcccgatctcagctcactgsaasccssacctcccgggctcaagagatccacccasstcagcttsssaagtagctgggactacacgcgcccgccaccacaaccggccta

SEQ ID NO: 33446 - DNA, 228 bp, Homo sapiens
attcttatgccctctatcaaccagatgagcaaagctccagaacagatgccttcccttggcagtctatggagttgaatgaagctgaaaactcaaggtcaaggtcagggaactgttcagtgagggagaattgcacaatactctcagtgtgctcagtaaccctaccatttcctttttccctcagatcctgtctcactgcaaaataaattctttcaatttgagtccctgcca

SEQ ID NO: 33447 - DNA, 115 bp, Homo sapiens
tattttaatacgaagaggacactcccgtgtggtaagggatcccgtcgtctcatagattctgtgtgcgtgaatgttccctcttggctgtgtagacaccagcgttgccccccgccac

SEQ ID NO: 33448 - DNA, 103 bp, Homo sapiens
  misc_feature 38: m=a or c
cttagtctttgagaatctcaaagcagagctctctgggmagagaactgtccacattgctaaataattaagattccctcacttttttgagggccatgtgttgagt

SEQ ID NO: 33449 - DNA, 258 bp, Homo sapiens
aagcattaccgggagcgggaatggcagtgccaccaggaccccgagactccgagccatgggggctgcagcacccgcgctgaggaagccaagggacggaggcaagcagcgggaagacccgttttcgaggcccgcccgcatgtctttgcagctcttctcaccaagaattggagtctattttctcaactcattaaatctgagctggctgtgtgacttgctttggccaaaaagactttagcaaataagatataagcaccgcac

SEQ ID NO: 33450 - DNA, 151 bp, Homo sapiens
  misc_feature 89: k=g or t
  misc_feature 106: m=a or c
ggacttccccaagctgtggatgatgaaggggcagatcgaggagcagaaggagatgatggagaaggcgcgggaagcctataaccaggggkttaagaagtgtccccamtccacacccctgtggcttttgctctctcggctggaggagaagatt

SEQ ID NO: 33451 - DNA, 367 bp, Homo sapiens
  misc_feature 300: n=a, g, c or t
ttcctaacaggtaacacctgaaagaatgtttagatttcataatcttttcatatacctacgatcatcacatttaaaaaagaactgtatttttgaattaaaagtagaaacagattatgcatgaattctgtatatggagtaggaaacactttcttaaaggtcagggagccaatgatcagaaataacaccagacggacagcaataggaaagacagagaatgatctgttaggtcgtctaacagcttatacattcaacctttccttgcctgtggtatttaaatgtcagtgcctgcccagaggtccngtagttatgtcttgtaaattaactctgttctttcaattctttagatgacacagtttatctctttgtt

SEQ ID NO: 33452 - DNA, 192 bp, Homo sapiens
gagtgataggtttggaatactgtagaaaggagagtgggcagagccagagtgaggtgtctgaagcttgtcgcacaggcagtgggaagggtgggttggaggtttctgagcaccagaaaactttgagcattgttccggaagaggcaagcggcaggcatctgcaccagagacactgccgggtccgagcgagggcag

SEQ ID NO: 33453 - DNA, 180 bp, Homo sapiens
ccttctagataatagccattttaatgggtatgaggttggtaagtagtaatgtttttgtagtgggccagttttactcattgatttgacaggattttaaagagatcagttgtctgaaataagacgtgaatgttacatgagagataaatgttttcagacactagaaaatcgcaatgccaacga

SEQ ID NO: 33454 - DNA, 142 bp, Homo sapiens
  misc_feature 39: r=a or g
  misc_feature 96: w=a or t
ggaaagcatgttacggaatcagagttacaatttagttarctctaggattatgacacaatttcaataatagaggcagcccagaataatagccaagtwaatagaatccctaatctttggcttgttcatatatttacccaacgtc

SEQ ID NO: 33455 - DNA, 238 bp, Homo sapiens
  misc_feature 201: n=a, g, c or t
caaagtactgctcttgtcccccaggctggagtgcagtggcacgatctcgggtcactgcggcctccgcctcctgggttcaagcgattctcctgcctcggcctcctgagtagctgggattacaggcacctgccaccatgcccggcgaatttttgtatgtttagtagagacagggtttcatcacgttggccagactggtctcgncctcctgacagcaggtgatcagcctgcctcagcctcc

SEQ ID NO: 33456 - DNA, 118 bp, Homo sapiens
ctgggattttcattgttcagtaaggaagcagtgttctacatttcactgcttaatcattttaattgatcttatagtcagaaatatggatctggtagccccacatggaaacagccggatc

SEQ ID NO: 33457 - DNA, 121 bp, Homo sapiens
gtatttccgcgggcgctgagcactagagagagcgtcttgtggctgcggcagggcccgaggagtggtcttcccaagaacccctggtggcctcccaaggccggtgctgtgtacctcctcaccc

SEQ ID NO: 33458 - DNA, 111 bp, Homo sapiens
caaaactgagagggataggaaagaaaaacttatccaggaaggaaaattggatcgaacatttcacctctcatattaagtctggcaatgatgactatatgtattcctgccatc

SEQ ID NO: 33459 - DNA, 175 bp, Homo sapiens
tgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagcccgca

SEQ ID NO: 33460 - DNA, 94 bp, Homo sapiens
tgaaagacagaaaaaaggagtttgaggagctcattgactccaaccacgacggcatcgtgaccgccgaggagctggagagctacatggaccccta

SEQ ID NO: 33461 - DNA, 94 bp, Homo sapiens
ttctgatgagtccagaaaactacgttttgtcagtagcaatacactaggcagtaaaatatatttagaattttaacattgtgtgccagtggtcctc

SEQ ID NO: 33462 - DNA, 225 bp, Homo sapiens
  misc_feature 98: k=g or t
  misc_feature 106: r=a or g
  misc_feature 114: k=g or t
tatctttggtttccaaacccagagaaggaagagtaactggcttcttctgtgtgtgggtacattgtgtcttattggagattgttttgtctcaagtattkgctggcaragtatttkattaatgggtgcactttaaaattttttgtttttcagactaccagtttaggtagcccagtactcaatatttgccaatttctagaattaaaaacatgtatgaatcactggcca

SEQ ID NO: 33463 - DNA, 178 bp, Homo sapiens
aaagcttttgggtggagctgaagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctac

SEQ ID NO: 33464 - DNA, 98 bp, Homo sapiens
  misc_feature 92: s=g or c
  misc_feature 96: r=a or g
aacacaggctgagcagtcaggcccacagcatctgaccccaggcccagctcgtcctggctggcctgggtcggcctctggagtatggtctggcsggtrcc

SEQ ID NO: 33465 - DNA, 94 bp, Homo sapiens
catgaatctagatatctgtttccttccctaaatttgggaagtttaaagttactatttctttaaattttttaaattactttaaattctaccacgc

SEQ ID NO: 33466 - DNA, 125 bp, Homo sapiens
  misc_feature 81: r=a or g
  misc_feature 82: s=g or c
  misc_feature 85: v=a or c or g
  misc_feature 86: s=g or c
  misc_feature 96: r=a or g
  misc_feature 97: k=g or t
  misc_feature 98: w=a or t
  misc_feature 99: m=a or c
  misc_feature 107: s=g or c
gtatcaaataaaaagggcaacttttaaaatattaagcctgaagacttctaaaaagacaagaaacatggcctaaataaccarsatvsgatttacatrkwmagtttcasactaccttattaccaaaa

SEQ ID NO: 33467 - DNA, 101 bp, Homo sapiens
acatggttttggctatggcttgactcatgggctttcagtgcttttttccatttgttgaaagtaacatttctctctctctctcttttttttttttttttttt

SEQ ID NO: 33468 - DNA, 93 bp, Homo sapiens
  misc_feature 71: w=a or t
  misc_feature 72: m=a or c
agggccgcactccggagactcgcggttgctacgcgcaccatggctggagcctccggacgggcccggctctwmgacgtgcgctctcgcgaggat

SEQ ID NO: 33469 - DNA, 66 bp, Homo sapiens
cctactagattggtcactgttcctagtctttttagtagacaaagctaggaagtatgtttcatctgt

SEQ ID NO: 33470 - DNA, 213 bp, Homo sapiens
taagcccaggggaccaagcaggattgtttaaaatgttttttaattttttatttttttagagatagggtcttgctccatcacccaggctggagttcagtggtgcaatcatagttcactgcagcctcaaattcctgggctcaagtgatcctctcctctcagcctcatgagtagcagggactacaggtgtgagccactaagacaagttagcttttt

SEQ ID NO: 33471 - DNA, 275 bp, Homo sapiens
aaaataaactggctcacaagtgtgcagtagttttaaactttctttttctttgcttcaaggattttgactctttcttctctgcaaaagaagagaatattatttattccttccttggtttggctcctcctccagactcaaagggatcagagaaggctgaagaaggtgcagaaactgaggcacaaaaagagggcagtgaagatgcgggcaacctccctgaagcccaggagaagaatgaagaagaaggagagacagccacagaagagacggaagaaata

SEQ ID NO: 33472 - DNA, 137 bp, Homo sapiens
  misc_feature 26: b=c or g or t
  misc_feature 41: b=c or g or t
  misc_feature 79: b=c or g or t
  misc_feature 113: s=g or c
taatctgtacactctctgctattgtbtgctgcatccaaatbttctccctggacctcgtgcatacgctggcccctgagcbgtcagtctcaggcccactgggacctctgggctgsacgtccccgcccccagcccctctc

SEQ ID NO: 33473 - DNA, 111 bp, Homo sapiens
tttttatttgttgcaatacattacaatttcagaggtactttggggctcaaaagctaggatttctaagtcagtatgtgcatttcacacgataaagctgttaatggtgagcgt

SEQ ID NO: 33474 - DNA, 140 bp, Homo sapiens
tacagattgaaaaagagggaccgtgtaaagaaaatggaaaataaatatctttcaaagactcttttagataaacacgatgaggcaaaatcaggttcattcattcaacgatagtttctaaacagtacttaaatagcggttgc

SEQ ID NO: 33475 - DNA, 136 bp, Homo sapiens
tggacaatgttgatatgtttgcttgtttttgtcttgatccatcatggtcagtagtcttgtctgatattgatgttcttctaacaggaggacatcaagtctttgctgtgagggtcaggtcttagcaacatcagggcgt

SEQ ID NO: 33476 - DNA, 271 bp, Homo sapiens
  misc_feature 49: w=a or t
  misc_feature 93: y=c or t
cctacattaaacttggtaatcttacatttatgtttatttctctggcttwggtgatgaatatggtatagtcatatcttacatggggttagggtyctaatgttagtaagggaaaaaaatcacatatagctaaaatcacccttgacaaaattctagagaaggcataatcatattggagactgccccatcaattctcagtagagcaggtagtcacttttatgtccagcgtttgaacagatggctagatggctagggtgattcttaagttgagtgc

SEQ ID NO: 33477 - DNA, 61 bp, Homo sapiens
  misc_feature 31: s=g or c
  misc_feature 32: y=c or t
  misc_feature 33: m=a or c
  misc_feature 52: r=a or g
cagcgactagtgaaaaaacttcaagatagtsymctagagcagtgggtaaatraccctcagc

SEQ ID NO: 33478 - DNA, 334 bp, Homo sapiens
  misc_feature 277: r=a or g
  misc_feature 282: r=a or g
ttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttaagcaatatcagctaaaaggrtatgraatcacaggtgatagcagttgtcattcagtaatttcctacaagcagcacacc

SEQ ID NO: 33479 - DNA, 159 bp, Homo sapiens
  misc_feature 151: s=g or c
  misc_feature 154: n=a, g, c or t
gcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcasgcnctgca

SEQ ID NO: 33480 - DNA, 57 bp, Homo sapiens
agtcttcagttataaccactccaccctcctcactttctctctctctctctctttttt

SEQ ID NO: 33481 - DNA, 105 bp, Homo sapiens
tggggttgtggggtcgcgtcagtgcggagacagcggtgtcctgcgcgtcttcggcttattgcaggagtgaccaggacactacctcctagaagtaatgcccagctg

SEQ ID NO: 33482 - DNA, 51 bp, Homo sapiens
  misc_feature 5: m=a or c
  misc_feature 50: w=a or t
ctttmtggtctcggccgcagaagcaagatgacgaagggaacgtaatcgtwt

SEQ ID NO: 33483 - DNA, 123 bp, Homo sapiens
gtatgtaggttgctaaaaaggattttcttaactcagattttaagccaaataaccatttaacactagtatttgttaaatggggtatttttctgtatttgtatgtttcactataataagggaagt

SEQ ID NO: 33484 - DNA, 83 bp, Homo sapiens
actttccgccgagaaatagggggcgcgtgtttggaaattgatagaaaagataaagggaccgagctgctgtcagcctggcctgt

SEQ ID NO: 33485 - DNA, 55 bp, Homo sapiens
ataaaatacttgaaaattacaaggagaaattccggagtgactctatcaccaacat

SEQ ID NO: 33486 - DNA, 52 bp, Homo sapiens
  misc_feature 19: s=g or c
  misc_feature 20: s=g or c
ctccaccacgtgacgcacssatggccgccgcttcctcttactgtcgtagttc

SEQ ID NO: 33487 - DNA, 261 bp, Homo sapiens
  misc_feature 17: s=g or c
  misc_feature 18: r=a or g
  misc_feature 19: r=a or g
  misc_feature 94: r=a or g
  misc_feature 95: s=g or c
  misc_feature 108: r=a or g
  misc_feature 109: s=g or c
  misc_feature 119: r=a or g
  misc_feature 129: s=g or c
  misc_feature 159: r=a or g
agcagagcccagaaagsrrgctagcctgcacgcacgccaagatggagctccaggctagcccacagaacagcccagccgcagccgtcctaccagrscagcaccttgtarscacagtctarcccagcgggsaccaggcgattgtgagtgccacggggctgrggcctgcgccgacctggtctgctggtgctaccacgcttgaacagtcttcaaatccactgctattaggcaaattacctggctcccgctgaactccagcaccta

SEQ ID NO: 33488 - DNA, 58 bp, Homo sapiens
  misc_feature 32: k=g or t
  misc_feature 33: k=g or t
ctccgccatcttggagatgggagacgggcgakkgctgtggtccttctgctaatgcaca

SEQ ID NO: 33489 - DNA, 310 bp, Homo sapiens
tcaaatatgtaactaagatgaacatgcatgcaatcaccccacgtgaagaagagggaaagctcatctgccccgaagcccctgcagaagacactgtgtttggtcccagcttgctttgctttttatagtatcactccctcatagccatccctaaacaccgggattagtttggtccggttttggacttaacttggatgcaggcatactctcagtatttttgtttggtttggtcttgctggtgttacttcatatggtatttgtgggatccacccacattgctgcgataagctgcactctattttcatggccaaat

SEQ ID NO: 33490 - DNA, 320 bp, Homo sapiens
  misc_feature 2: r=a or g
  misc_feature 12: r=a or g
  misc_feature 14: r=a or g
  misc_feature 171: s=g or c
  misc_feature 205: r=a or g
  misc_feature 282: w=a or t
aragctcgagargrccacgtgaccgtcccggggccagtcacgtgaggcgcagatcctggctgggagggggttggtagaggggtccagagtggcagtaaaggaggaagatggcggggtgcagggggtctctgtgctgctgctgcaggtggtgctgctgctgcggtgagcggsgagacccgcacccccgaggagctgaccatccttrgagaaacacaggaggaggaggatgagattcttccaaggaaagactatgagagtttggattatgatcgctgtatcaawgacccttacctggaagttttggagaacatggataataa

SEQ ID NO: 33491 - DNA, 327 bp, Homo sapiens
  misc_feature 9: m=a or c
  misc_feature 39: n=a, g, c or t
  misc_feature 93: w=a or t
  misc_feature 147: r=a or g
  misc_feature 164: m=a or c
  misc_feature 183: r=a or g
  misc_feature 186: m=a or c
  misc_feature 188: v=a or c or g
  misc_feature 208: m=a or c
  misc_feature 225: r=a or g
  misc_feature 266: m=a or c
  misc_feature 288: w=a or t
acatttgamtgctggaggaagattactcatgatgaaggnagcaaagctgttttcaagggtgcatggtccagtgttctcagaggcatgggtggwgcttttgtgcttgtcttgtatgatgaaaccaagaagtacattcactcctaatarataacaaatttggagamataaaaatatcttaagaaragmavaaagaaaagagaagaaaggmttcacaccatggaatgrcaagtgctcaaatggctctcagtaagtgctcacggggacamcactgtcagagtggtgagcaawcatctaccacaaaatggaacaaagcagcagaggtacgta

SEQ ID NO: 33492 - DNA, 397 bp, Homo sapiens
  misc_feature 2: w=a or t
  misc_feature 223: m=a or c
  misc_feature 224: k=g or t
  misc_feature 323: r=a or g
  misc_feature 324: s=g or c
twtaaaattgttagcttaacagaaactctgaaagttctggaagataaatgttgggatcaaggtgttgacagaactggtttcttctgaggacagtgaggaagtgtctgttccatgcctatcccctggctgctagtggtttgccaacaatctttaatgttgcttgacttgtagaagcttaccctcatctctgccttcatcttcgcctggcattttccccatgtgmktgtctatctacaaattccctccttataaggacatcagtcatagtgaatcagggatccatgctactccacaatgacctcatcttaacactatatctgcarsaagccatatttccaaataagaccaccttctgacatgagagttaggacttcaacatgtagattttggggagcac

SEQ ID NO: 33493 - DNA, 69 bp, Homo sapiens
attttccactgacagtatccccagggtgtctatttaccttgattgatattattttatctcttttgggcc

SEQ ID NO: 33494 - DNA, 51 bp, Homo sapiens
  misc_feature 24: r=a or g
tagaaaccggcaccctctctgagrggcaacagaagcagcaattgtttcagc

SEQ ID NO: 33495 - DNA, 253 bp, Homo sapiens
taatcacagtaaaaatttctgtttaaaatagacaagaataggaaactggaggggtcttgggtctatagcagtgataaaatcttgctaggtggaaattctgaggacagtgaaggcgttggaataagttcctggttagcccatctagcagtctgattctgttgtctgggagaaacccccttgcccattgtactccatgtgacccctggctttgccctctggcagattttccttgtttgttttctttaaaggccta

SEQ ID NO: 33496 - DNA, 338 bp, Homo sapiens
  misc_feature 8: m=a or c
  misc_feature 35: y=c or t
  misc_feature 36: k=g or t
  misc_feature 40: h=a or c or t
  misc_feature 41: y=c or t
  misc_feature 138: k=g or t
  misc_feature 240: y=c or t
  misc_feature 304: y=c or t
  misc_feature 322: s=g or c
atcatagmaggaacatgttgtaaatagtgtttttyktgthygtttgtttgttttttttgagacggagtcttgctctgtcacccaggctggacagtggcaagatctcggctcactgcaagctccgcctcccaggtccakgccattctcctgcctcagcctcccgagtagctgggactacaggcgcctgccaccacgcccggctaattttttgtatttttagtagagacggggtttcaccgygttagccaggatggtctcgatctcctgacctcgtgatttgcctgccttggcctcccaaagtgcygggattaacaggcgtgascactgcacacggccgt

SEQ ID NO: 33497 - DNA, 227 bp, Homo sapiens
  misc_feature 98: r=a or g
  misc_feature 99: r=a or g
  misc_feature 139: n=a, g, c or t
  misc_feature 140: n=a, g, c or t
gcaaccttgggaaaattgagctaatttagtctctcagtttgtttcttcacctgtaaaatgggataatacctacattgtaagattttctgtgggattcrrtgagctaagttagtagatatgcaataaaatttaattcttnnccttcttggctcatgtttatcatcctaaataaactctctcatcccatactctgcctataaaagttcttctcagtcttcaaggcgacg

SEQ ID NO: 33498 - DNA, 128 bp, Homo sapiens
tttctctagccgaatctttttcgaacagcccgggaaaggaaaacggattcacttgctgattttgttcacggcggaagcaccatgttccgttcctttttcaggttcagtttgttgtgtaaatggcggta

SEQ ID NO: 33499 - DNA, 81 bp, Homo sapiens
taataattgagaggtcactccaaggcaggttccaagctagaaatgatcagatgagtgatctcatttaggctgtcagagact

SEQ ID NO: 33500 - DNA, 104 bp, Homo sapiens
  misc_feature 66: m=a or c
cttgtaaaatgtttccttaaagtgttcttgggatgaaaatgattgtcatgtctccaacaacagtgmactgatgttgttccttggaataaaagtcaatccccata

SEQ ID NO: 33501 - DNA, 247 bp, Homo sapiens
  misc_feature 117: r=a or g
gtaaataaataggaggctgtatatttttgaagttgttgatccgcactgaaatagaagtctctaggatctgcatataaacaataaatgtttcctagaaattagtggttttgtttgggrattagaaaaatttacattctctcccaggtaacatagttctctcaatgtaaacttggaacctgaaaccctacttaatttagagaaagaaatgtctgagaaatagttcccttgatttcttatgctggcatca

SEQ ID NO: 33502 - DNA, 374 bp, Homo sapiens
taaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatc

SEQ ID NO: 33503 - DNA, 356 bp, Homo sapiens
ctatctatctatctgtcctctatctttatctatctatctatctatctatctatctatctatctatctatctatctagttgcctgttggttctgtttctctagaaaactctgattgaaacaggtgggaagggagaaacaaagagagaatcttccatccactgccctgagagcaaacctaattatgtctttacatcccttgctaagactgacagatatgatataaattgtttctggtaagtgacaaggatcgatttctgaaacgtcatttctcacaggaattcctcctcttctgcacagcactctttgctgcaacaaatgtttactttgcttttcttttactgtcttaaactgcctac

SEQ ID NO: 33504 - DNA, 247 bp, Homo sapiens
  misc_feature 29: k=g or t
  misc_feature 99: k=g or t
  misc_feature 155: k=g or t
  misc_feature 164: r=a or g
  misc_feature 177: d=a or g or t
  misc_feature 183: d=a or g or t
  misc_feature 184: s=g or c
  misc_feature 189: k=g or t
  misc_feature 234: r=a or g
aaggcgggctggcgggctggcggcagtckctacttgcctagtagcctcagccgctgtgggctcctggggagatggaggggccggggctgggctcgcagkgcaggaatcacagccatggcccccaccctccaggatttggtcgatatggcatctgkgcacatgaraacaaagaacttdccaatdsaagakaagctcttcctcttatagaggactctagtaactgtgacattgtcraagctactcaata

SEQ ID NO: 33505 - DNA, 169 bp, Homo sapiens
cagtaggtggtcctaaaataaattcatcagtaaatcgccaggtgcagtggctcacacctgtaatcctagcattttgggaggcttgggcaggtggatcacctgagatcaggagttcgagatcagcctgaccaacatggtgaaaccccgtctctactaaaaaatacaaaaa

SEQ ID NO: 33506 - DNA, 326 bp, Homo sapiens
  misc_feature 162: s=g or c
  misc_feature 163: n=a, g, c or t
atccccaaacacatagagagacactctctgtctctcgattacaatcatgatttccagaatggagaagatgacgatgatgatgaagatattgattatgtttgctcttggaatgaactactggtcttgctcaagtttcccagtgtacgactacgatccatcctsnttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagacaacatgcaggt

SEQ ID NO: 33507 - DNA, 169 bp, Homo sapiens
tatagggatataaagtattttgtctaatttaaaataatggaagtttttaaaccaaggctagtagcattagttttttgttttattagaacttctgtttggcagatctacatatccgattactaaaaatgagaaaacgaaattattacaagactgcagattgtttggacat

SEQ ID NO: 33508 - DNA, 274 bp, Homo sapiens
caatttatctcagtcaataatattgtatatctagtatttaaacaggaaactctgtaattagtctcaattctttcttttcagtattaagagtataacttgtttgtcatcaatccaaatgagctttgtccttgatctgtcctttgctgtccaccccacttcccgaggccaagaccttagttgtctttccacagttagaccactatagtagcctccaaactggactccatgcctctagaatctcccacttttccgtcttcctcttatattgcagccc

SEQ ID NO: 33509 - DNA, 307 bp, Homo sapiens
agagctgcttggagagctaagctggaagggtgcttatccctgcgtagaaacgcctgccaatgctttctcatttggacccagactccagatcgggagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctagc

SEQ ID NO: 33510 - DNA, 353 bp, Homo sapiens
  misc_feature 177: m=a or c
  misc_feature 263: m=a or c
  misc_feature 326: y=c or t
tttaaaacaggggtcaggtatgcttttcaataaaaactggtgatagcagtggtaaaatgtttcatcagtatgattatactcctaggtgaaaaaaaagatggagacaagggaaaaaatgaagttaacgaataaaacaaatgttatttcagatcacggccctgtgtgtgttactaaggmaagatataaggatttataacatatatttgttttccatttatttttatgaaggaattaaagaaattatcagaaaatactaaaagggmacaaagcattttaaaaacattccaacaatggcatgctgctttttatacagtatgcagtgaagytccttgcatttcaaaggcaagggtagc

SEQ ID NO: 33511 - DNA, 331 bp, Homo sapiens
  misc_feature 323: y=c or t
ccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctctaattctcctaaaataycgatggcg

SEQ ID NO: 33512 - DNA, 240 bp, Homo sapiens
tagcttaaatgtcacttcctctataaagcattccccatcatcccatcctgagttagtccctcacgctcctttaaaccagtacctactcttattttctcattctgaaatctttccatgaaagcaagaatcttagtgttctctttagctccccacctttcccacgcccctatatgctaagagcattgtctctacgtctgtaatgcctttcagagccacctgttttagttcctactgccccaa

SEQ ID NO: 33513 - DNA, 144 bp, Homo sapiens
aggcctcggccggcgcggacccctggttgccccggggtcgagagcagccggggagagctgagttcagagcccagagttggacatcaggccacacgctgagagggtagtaaatgaaagggagtccggtttagtcgcgggcagggc

SEQ ID NO: 33514 - DNA, 182 bp, Homo sapiens
  misc_feature 105: k=g or t
aacaaaaaaggtaaaagacgtaatatgtggcctaagggagcttttaggtgactgctgcacatcaagcagaaaatcaaggactatctaaagacgtttatagtagakaagatcagggtagaccagatggtctgggaaagttctgtgcctctgaggctttgggttgtagtcaatggcaggacaga

SEQ ID NO: 33515 - DNA, 389 bp, Homo sapiens
  misc_feature 73: v=a or c or g
  misc_feature 168: r=a or g
attttcaacactgaagaaaaatgaaacattatttagaaaacaatgagattacaagttccaaactcagccaggvatgtggctcacacctgtaatcccagcactttgggacacctaggtgggagcatcgcttgaagccaggagttcaagaccagcttgggcaacgtagtragacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacaac

SEQ ID NO: 33516 - DNA, 371 bp, Homo sapiens
  misc_feature 249: s=g or c
tttatgatatattacctcccccaaattgatttttattttaaatatatactagtgtgatttgacactgaagtttacaatgtaattgctaactatatttataaatcagtttgggttctaactgcctaatgaatgttgaccatctttatgtagaggaatttttctttaatgatggagggaatagggaagtatattgtatctgaggagacagtgtcagcttattaaatctaactgaagaaagtatatttttastgttaccttccaccttacttttattaaagaaaatcttggaaagctagaagataagatactctacaaagttattcattattgggaactctcatctcagaagagtgacttaagacagggagcct

SEQ ID NO: 33517 - DNA, 59 bp, Homo sapiens
  misc_feature 5: r=a or g
gaggrcctcaggctgcagcggagccatgcccagatacacggtgcacgtacgtagggaat

SEQ ID NO: 33518 - DNA, 100 bp, Homo sapiens
  misc_feature 21: k=g or t
  misc_feature 58: r=a or g
  misc_feature 71: y=c or t
  misc_feature 72: s=g or c
  misc_feature 93: y=c or t
acaatgtgttaatatcctgtkcctcatcaaactttcacccactagttttagcgtccartgatgactttccystgcatgcttccttctgtagcyattgatt

SEQ ID NO: 33519 - DNA, 304 bp, Homo sapiens
  misc_feature 51: m=a or c
  misc_feature 123: y=c or t
  misc_feature 125: k=g or t
  misc_feature 126: w=a or t
  misc_feature 177: r=a or g
  misc_feature 230: w=a or t
  misc_feature 254: r=a or g
  misc_feature 287: w=a or t
tttctaagaaagtttgatgagtataggtatacacaatgggaactctaaggmagtgttgaggcctacatatatttagctgtctttgctattaatgatatgtttgtattgtttgctcctgagaayakwaatatgtctgttccattaatgttcagtttttttatgcatttaataaatgcrtagcattgtgctaagtattctactcaaaaatttaagataggatccctggccawcaaaaatcacttggggattaccarataaaacaaatgtctgatgtaattgtgattgcwagtagtgttagtagtgt

SEQ ID NO: 33520 - DNA, 167 bp, Homo sapiens
tgaagatactctctctttattcctagtttgctgagtttttatgataatgagtgctagattttgcaaaatgctttttctgcacatgtcgataggttcatgtgatttttcttttttagtctgttaatgtattggattacattaatgaattttcaaatattgaaccagct

SEQ ID NO: 33521 - DNA, 225 bp, Homo sapiens
caaaagaaaacaaacaaaactaacctaatgtgcctcatatgccaaattttcccatgtttacttaatttttttctcttatgtcatgatttcaaaaatcttttattctgataattaatgacagtaaaattaatgtacatcttggaagactacataggcacatgccacatcgaagattgtttactgcaagcaacataagaattttcctttacttgtttaattgggcaa

SEQ ID NO: 33522 - DNA, 70 bp, Homo sapiens
  misc_feature 12: b=c or g or t
atctctttcaabgtttctgctgggtttctgaactgctgggtttctgcttgctcctctggagatgcagcgt

SEQ ID NO: 33523 - DNA, 236 bp, Homo sapiens
gcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcaac

SEQ ID NO: 33524 - DNA, 128 bp, Homo sapiens
ttgtaacttgaagcgtaaatgcttgaggggatggataccccattctccatgatgtgcttatttcacactgcatgcctgtatcacagtatctcatgttctctgtaaatatataatcctactatgcaccc

SEQ ID NO: 33525 - DNA, 119 bp, Homo sapiens
  misc_feature 96: m=a or c
acttatacattgtacattattcttgaatgcttttcctctgaggtggagaacaaggcaaggatgcctgttctcaccacttacgttcaacatggtagmggaggggcctacacacaacatac

SEQ ID NO: 33526 - DNA, 224 bp, Homo sapiens
  misc_feature 91: w=a or t
agtaaaagcttcaacttcccacactgaagctgagagcctcccaaagtgctggctacctgctgagcgcccccgtaactctgacacagtagtwatttgagcctctgcaattgccgtctgcttcctgtgaaagtcctttccgtgcccactgacccttgagtgggcctttgagctgctgactttcagctggaacttgaagggaccccaaccctgagacactatggcca

SEQ ID NO: 33527 - DNA, 51 bp, Homo sapiens
tcttaagtttttgctccatgatcaatgaattatgagttaatttttgtgtgt

SEQ ID NO: 33528 - DNA, 158 bp, Homo sapiens
taaaagtgaactcatactggattacttttgattgttaaaattcctgccaggtaagaacctgtctgaatcctgtcctgcacagagtggctggtgaggacataaagaactatagctttgctcagcttgcaagccttgcctaaattttaaccctaactgcc

SEQ ID NO: 33529 - DNA, 173 bp, Homo sapiens
cctttccatcctcattgccctgctgttattacataggccctggttcaagtccttgttacttgttcccattattgcaataacttctaattccaatgccgttgtgtgatcccattttaaacacggccagagcagtcttccaacaacatagctctaatctagtttcatccccacga

SEQ ID NO: 33530 - DNA, 279 bp, Homo sapiens
  misc_feature 21: s=g or c
  misc_feature 72: y=c or t
  misc_feature 73: m=a or c
  misc_feature 190: r=a or g
  misc_feature 215: m=a or c
  misc_feature 238: r=a or g
catttaacctttgggaacaasgcaactagcgtctggcagcaggaatccaaccagtgccctgagttctgaggymgagaggaggacagaagaaacaagaggctggagattgtcaaattcagtatcccagttggctcttgattcttggtgaaaccatccctcagctcctagagggagattgttagatcatgaractaattaccatccttttcctctgmtccaaggctactactaagtttarcccaggaatcaacagtccgaggaaattgactgcaatgacaa

SEQ ID NO: 33531 - DNA, 160 bp, Homo sapiens
tcggagtctacattgcctttaagaaactatgacttgtagtaagccgggcgcggtggctcacgcctgtaatcccaacactttgggaggccaaggtgggtggatcacaaggtcaggagttcaagaccagcctggccaatatggtgaaagtccgtctctacct

SEQ ID NO: 33532 - DNA, 262 bp, Homo sapiens
ccaagatctgtcacttaatagctgtatgaaaatgagcaagttattaggttctctaagacgttttcctcccatctgcaatgtgaaaacaaaaataatacctacctcatggcattattgtgaggatttaatgacaacaaatataaaaggtttaaaacaatgcctgacatttattaagcaaacaccaaatgtggcctcattttgatgatgatgatgatgatgatgatgacgacaatgaccatgaccacgacaataatcgagccta

SEQ ID NO: 33533 - DNA, 225 bp, Homo sapiens
taataagcaacagagtcagcatttgaacctaggcagtatagtttcagagtttgtgacttgactctatattgtactggcactgactttgtagattcatggtggcacataatcatagtaccacagtgacaaataaaaagaaggaaactcttttgtcaggtaggtcaagacctgaggtttcccatcacaagatgaggaagcccaacaccaccccccaccacccgcacc

SEQ ID NO: 33534 - DNA, 147 bp, Homo sapiens
tatcagcacatagagagaggtttacgtaatttctctttcaatagttgagtggaggccaggcgtggtggctcacacctgtaatcccagcactttgggaggctgagaagggcagatcaggaggtcaggagtttgagaccagcttggccg

SEQ ID NO: 33535 - DNA, 376 bp, Homo sapiens
  misc_feature 137: s=g or c
taaggattaggaggaaataaattccaaggatttgtggtagcttggaggccaagaggaactcagcatttttggagttctgagtagctgaagtctggagtgggggccagatcgtgtgaatcaaattattgcattttatsatgtcagcagtggggagcaactgcagggttttaagcagggaactgacacacatgaattttgaaggactgctgtagactgtatggagcatggattaaatgggaactgaactgtaggcaggaaagccagttgaggagattttgcagtagttcatggaagggatgataggtggctttgattagagcagtagctgtggggatggagaaaagtggacaaattaattagagagatttagagacag

SEQ ID NO: 33536 - DNA, 230 bp, Homo sapiens
taacctggtttgaaaataaatatttcttactcattgtaaagagtaaagtgggactttaacatgatctttttctcattattacagcagtacttgcttattatgggaaaagaaaaaatacagttgagtagaaagaagaaaataaaaactaaaaacattaacaatatccacacctttttctatcaaacagcataacatatagatgtttggaaaaatataggaaaatgtccacc

SEQ ID NO: 33537 - DNA, 202 bp, Homo sapiens
  misc_feature 17: s=g or c
  misc_feature 120: r=a or g
aagtggatcgtgcggasaagcatcacaccatggcgtatgagtgttcctctgtgtagactcaacctgcgcctcgccgtcccccattcgcacacccgatgcccgggggtcgctacggacttraaatctccgcaccgcaccctccacctcagaaacgttcctggatccgaacactgccccctgacgacctagagagatcccgcct

SEQ ID NO: 33538 - DNA, 291 bp, Homo sapiens
tctctctttccaacctgtatactttttattaccttttgttgtcttactttactagctaagatgttgaatagatgaatggtaagagaagacatccttgccttgttcctgctcttaggggaaaagagtctagtttctcactattaactgtgatattagctgtagggccttttttggtagatgttctttattaagttgaggaaattatactttattcctactttgctgagagttaatcatgaatggatattaaattatgaattatgtcaaatgcttttttgttgtcaatggatt

SEQ ID NO: 33539 - DNA, 252 bp, Homo sapiens
cataaaaaaggaaggaaattctgacaactgctacaacatggatgaaccttgaggacgttatactctgtgaaataagccggtccaaaaggggcaaactctgtatgtgtccacttatataagaacagtcaaatctatggagacagaaaggagaatggtgtttacaggggcaggggagggaatggggagtgaatgtttatgggggatgggtttcagtttgggaaggtgaaaagttttgtggataaagggtagtga

SEQ ID NO: 33540 - DNA, 232 bp, Homo sapiens
  misc_feature 61: m=a or c
taaaaaaaaaagccattcaagatatttcaccctggtagatattcaagctttgtgaagttamattctgaggcactcccaggctaaagcagtttgttaattgaagttcctgcaacaactcgtgagatggttgtttggagaacttcagttgaaggggaaagcatttgtcctcatattttgaaaaaggctgatcatttttcatttgagaaagtctcttttcctaagaagggtgaac

SEQ ID NO: 33541 - DNA, 125 bp, Homo sapiens
tagcatcagagagttaagaattgaacacaagcgactcaatattataacctaatcaaggagagcttaaaagtattattttgatcaatcagcactgctttcaaatgcagcccactttttgctggtcg

SEQ ID NO: 33542 - DNA, 281 bp, Homo sapiens
tgatgttagttcctctcttggattgctatagttcactcatataaatgtagatactgaactcttatgcaaactcattatgtatgtgctttgatatgtaaactatttctttaaaatatattcatatacttaaaccaaataacaccagcagatgcatacaagagctacctcttgagtcattttatctcgaacctcacttcccaatgcagaataaattgctccctcatccatgttcccatagtgttgtataaagacctgacctcacagtcttatagttcctagtt

SEQ ID NO: 33543 - DNA, 208 bp, Homo sapiens
taggacttcatgcaaaggcaagggagctatgagcaactgcttgggacaatagtatttagctaacacaattcaaatttcctccatgggatgggttgttttaaaaatcttgtccttgaagtgtgaagacattccaggaagtcagtaaagctgcagcctcttaagtagctaacaatattttgtttacccactaatgaaaaccagagcaagg

SEQ ID NO: 33544 - DNA, 178 bp, Homo sapiens
acttgccttgtaactgagccctcatatgaccaattttaaaaagtttcactgtgttgcccaggctggagtgcagtggcacaatctcggctcactgcaacctcggcctcctggttcaagcaattctgcctcagcctcctgagtagctgggattacaggcacacaccaccatgcccgtcta

SEQ ID NO: 33545 - DNA, 355 bp, Homo sapiens
acatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcca

SEQ ID NO: 33546 - DNA, 121 bp, Homo sapiens
  misc_feature 47: r=a or g
  misc_feature 48: m=a or c
agtgacgcaatctcggctcactgcaaccttcacctcccgggttcaarmgattcttctgcctcagccttctaagtagctggcactaaaggcgcgcccagataattttttttttttttttttt

SEQ ID NO: 33547 - DNA, 202 bp, Homo sapiens
aaagggtagaggaagttacttgtttttctatgtgtgtgtgtatgtaattatatattaatgtgaacacacactgtgtgtatgtatgtttgtgtatatatgtaattataaatatgaatacactgtgtttgtgtatatgtaaacaggtacgtgtgtgtgtgtgtatatatataaatagatatatgtgaaatcattaaaagagtgc

SEQ ID NO: 33548 - DNA, 59 bp, Homo sapiens
gaaatgtcatttgagttttgtgtcacatggtttgatgaatttctaggaacttttttttt

SEQ ID NO: 33549 - DNA, 135 bp, Homo sapiens
gggtccatctggttcacactgatgtccatgatcattgagttcattttttatatcaactatgtgacacttcctatagtttccagttcctggttagaatttgcaaagttgccgactatttctttgaatagagtagct

SEQ ID NO: 33550 - DNA, 182 bp, Homo sapiens
cttatataggcaaaaggagttaaatgtaaaaggaacagagatttaagtactataggaacttaaagaaggggctatatcatacagctggaggggcttggaatagctttgcagaggcttcaaaggatgtgtgggagataggagggaaggggcagagtggaaaaaagcatgaaagctggccccaa

SEQ ID NO: 33551 - DNA, 311 bp, Homo sapiens
  misc_feature 233: r=a or g
ttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaargaaataaaatgcacatagatttgaaaggatgaaatacaactttgttcacaagtaacatgattgtctttgtagagaatt

SEQ ID NO: 33552 - DNA, 334 bp, Homo sapiens
agctgttcatttcttagtgcttgccactataatattcagagctacagttcgctgagcacctgtttcaatagagttgctcacttgggagatagattctaaagtccgagcataaagagaacatggcacagaggaagaattagccttgaaagatcccttaaatcatctgtaaagtacagtgtacatcggaggtcatcagactttttctataaagaccatatagtaaatattttaagctttgcaggccacctgtggtctctgtcacatatgctgctttattttcctttttaaggaaagccctttaagatgtaaaaaccttttgttagctctgggccac

SEQ ID NO: 33553 - DNA, 140 bp, Homo sapiens
  misc_feature 32: k=g or t
  misc_feature 95: r=a or g
atgtgagttgctgcactggcctgcaagtttckatcttttttttcaaatttttttgcgtccctcccctctatcccaaccccaccccattttgcctrgggcaggcttctttttatttctttttttttttttttttttttttt

SEQ ID NO: 33554 - DNA, 211 bp, Homo sapiens
  misc_feature 71: r=a or g
taattttggtgtcaaggtaatgcattctggtctttgaatgcatttggggagtgtcctattctctggaagartttgtgtaaaattagtattaattagttaattgatttttttttagacaaggtcttactctcttgcccaggctgaagcacagtggcacgatcacgcctcactgcagcctcaacatcctgggctcaagcagtcctcccggctc

SEQ ID NO: 33555 - DNA, 216 bp, Homo sapiens
  misc_feature 41: w=a or t
  misc_feature 109: s=g or c
aaataaataataaaatttattgaatggtaaaaaaaaaaagwtacatattcaattttttttctgggattcttcataataagatttatattcataaatatttacaggatasctaatggtaaaggcatttctatttgatattaaaataacatttcaaacatataggtaagatgtacgattattttcatgttctttgtttttcacaattttggggggggt

SEQ ID NO: 33556 - DNA, 223 bp, Homo sapiens
  misc_feature 2: b=c or g or t
abgcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaa

SEQ ID NO: 33557 - DNA, 178 bp, Homo sapiens
agagtttcaccctaagaagaaaggggaagcaggtggaaaagcaattaaaaaaaaatcagcatctctctctaagctattatctcctgttagacacagcccagaaaatgaatagagacaagtcctggctgggtctgggttcagaaacataatagaaggattcatctaaactgtcggccaa

SEQ ID NO: 33558 - DNA, 66 bp, Homo sapiens
  misc_feature 51: r=a or g
tttcctccgcggatccgcggctggacttggaccagggctctcccgacagcrccctggaacccaaat

SEQ ID NO: 33559 - DNA, 179 bp, Homo sapiens
  misc_feature 72: y=c or t
  misc_feature 75: k=g or t
  misc_feature 129: w=a or t
  misc_feature 130: y=c or t
tacaactaagctttctagaaggttagaaatagacccacaaaaataccatcatttgatattcaatgatgttcyttkgaatcaaatagttttgtaaagtctatacatcttagggactaaaatgaatctcawytcctgcatcacaccttactgaataattagaggaatggagtacggacctt

SEQ ID NO: 33560 - DNA, 291 bp, Homo sapiens
  misc_feature 68: r=a or g
  misc_feature 71: w=a or t
  misc_feature 72: r=a or g
  misc_feature 77: m=a or c
agagagctggaagtgagagcagatccctaaccatgagcaccagccaaccaggggcctgcccatgccarggwrgctgmaagccgccccgccattctctacgcacttctgagctccagcctcaaggctgtcccccgaccccgtagccgctgcctatgtaggcagcaccggcccgtccagctatgtgcacctcatcgcacctgccgggaggccttggatgttctggccaagacagtggccttcctcaggaacctgccatccttctggcagctgcctccccaggaccagcggaca

SEQ ID NO: 33561 - DNA, 371 bp, Homo sapiens
  misc_feature 92: r=a or g
cttaggagtttgaggttgcaggaagctatgattgtgccactgccctccagcctgggtgatggagtaagaccatgtttcaaaaacaaaacaaraaaaaagaaatgcaagttagaccaatgaagtataatgtaatgaaatacaaaaaattcattgctatggtttcaaattcccagtgcaattaacctttaagatactacgtgtcaggcctctgagcccaaactaagccatcatatcccctgtgacctgcatgtataaatacagatggcctgaagcaactgaagatccacaaaagaagtgaaaatagccttaactgatgacattccaccattgagatttgttcctgccccaccctaactgatacgatatattct

SEQ ID NO: 33562 - DNA, 387 bp, Homo sapiens
  misc_feature 61: w=a or t
  misc_feature 199: s=g or c
  misc_feature 200: s=g or c
  misc_feature 288: n=a, g, c or t
  misc_feature 289: n=a, g, c or t
ctatttcaagattgtgaaaaagagcaagacaacaaaacaaaagatccaacccatgatgttwaaaacccccaatacagaaacgaggacaagttgcttaattaaatataatgtgtctactacgccatacttgcaaagtgtgaaaaaaaggtgcagtttgatggaacaaattccgcatttaaagagctgaagtttttaacassagtgagacgttctcgacgtcttcaagagaaaacttctaaattgccagatatgttaaaagatcattatccttgtgtgtcttcattggannggctaacggagttggtaagagaaactgatgcttttgtatgccgccctaatgcagcactgtgccgggtgtactatgaggctgatacaacataagagaat

SEQ ID NO: 33563 - DNA, 311 bp, Homo sapiens
  misc_feature 2: s=g or c
  misc_feature 72: b=c or g or t
  misc_feature 73: s=g or c
  misc_feature 193: h=a or c or t
  misc_feature 282: b=c or g or t
  misc_feature 284: b=c or g or t
asgccagcgaggcagtgtccatggtcccagtcttcttccaccggaagaaggcacaacctgcatctgcagccbsagggccattgggttaggcctgtggccaaactactaaggtgctgggagactgaggaggcccagctcctcctggggccaccaagcccgtggttgacggcctccccatggaccgggctgtcchgagagcagcaagtcagccggggccctcagggccgctgaggccactgctcagtgtcgccgtaatggaaacttctcagctggttgtgagcbgbaacagctctggttcacaccctgcgaca

SEQ ID NO: 33564 - DNA, 169 bp, Homo sapiens
acagaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccagaatt

SEQ ID NO: 33565 - DNA, 97 bp, Homo sapiens
aaagcctttatgtgttaattttttaaatttttatattttttcttgaaacatttatacttaatattttaatttacaaataaatatgcaaagaaggggg

SEQ ID NO: 33566 - DNA, 328 bp, Homo sapiens
  misc_feature 121: n=a, g, c or t
  misc_feature 122: k=g or t
taataattatagctggaaaatgttttttggaaagtttttttatcttctttcacactaaggctaatttttaaatacagctaaataaggacttaggccaatccctgaaccaaaaagcaaggtnkgaaccttaatttactgaaccacaaacctaacctcattttttaaaaactgaagtgctaacaactttttttttaacacatatgtctagtgaagcaatagcaggaaccaacacttcatgttttctaaactgagtgaagtagcagtagcactgcaagatgatttttttaaatggaacttcaaactggagcttcatcgattctctgcctct

SEQ ID NO: 33567 - DNA, 170 bp, Homo sapiens
ccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctcat

SEQ ID NO: 33568 - DNA, 67 bp, Homo sapiens
  misc_feature 5: m=a or c
  misc_feature 14: s=g or c
tggcmcagggccasgcaccgggcagctggtgtttggaggtcaccatcggactccagtctgtaccact

SEQ ID NO: 33569 - DNA, 147 bp, Homo sapiens
  misc_feature 78: k=g or t
  misc_feature 91: r=a or g
  misc_feature 92: w=a or t
tggaatttttcaagcattacaaaaggagacagactagtaagattaactgctgcatatccatcatcaagcttcagcgaktatccacaatccrwggctgatagtatttcgtatatatataggccctatccatttccccaccccaaaatc

SEQ ID NO: 33570 - DNA, 184 bp, Homo sapiens
  misc_feature 37: m=a or c
caagtctttattcaccacttgcctatgttctttaggmaagagggacattgatagcacgtaggcaccacccaaagccctgaatccagtcgtgcctttctttgcttcctgcccaggcagccaaatccatttaaccattgcccagaaataattatgtgatttaatatttgggattggtggggaactg

SEQ ID NO: 33571 - DNA, 113 bp, Homo sapiens
tccttttgtgcttaatttattaaaatagttgctgtataatttattttcataaactataaaaaaatactaaatggttaaaatagacttgcaggccaatcttaaatagggtgggg

SEQ ID NO: 33572 - DNA, 69 bp, Homo sapiens
  misc_feature 19: n=a, g, c or t
  misc_feature 20: k=g or t
  misc_feature 22: h=a or c or t
  misc_feature 23: w=a or t
  misc_feature 37: s=g or c
  misc_feature 51: w=a or t
tatctgatcttctgctacnkchwtctcctttgtccgsccctgctctctggwttctcttgtacactctgt

SEQ ID NO: 33573 - DNA, 310 bp, Homo sapiens
  misc_feature 34: y=c or t
  misc_feature 248: r=a or g
taaataaagtaagacggtgacagccgagtgtggygtctcacgccggtagttccagcactctgggaggccgaggcaggtagatcacgaggtcaggagttcgggaccagcctgaccagcgtggtgagaccctgtctctactaaaaatacgaaaattggctgggcgtggtggcacatgcctgtggtcccagctgctcgggaggctgaggcgggagaatcgcttgaacccgggaggcggaggttgcagtgarccgagatcgcgccactgcacgccagcctgggcaacagagcgagactccaccccctcccgccc

SEQ ID NO: 33574 - DNA, 71 bp, Homo sapiens
ttaagcattacatttttttctgaacttttaaattctgtaccataatgatacgctgttttataaacacactg

SEQ ID NO: 33575 - DNA, 248 bp, Homo sapiens
gcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccat

SEQ ID NO: 33576 - DNA, 66 bp, Homo sapiens
acgaacacctgcggcgtgccgaagttcctcttctctgccccggttccgggcggtccgctgggaggt

SEQ ID NO: 33577 - DNA, 181 bp, Homo sapiens
  misc_feature 42: y=c or t
caaaggtaagtgttaaactttgccatatacgtttcctgcatyatgaaaataatcagagtgggagtggccaagatggccacctagaagcagcttaggtgtatggctctcaaagagagaaacagaaggggtgaaatctagagaaccccagtaagatactccatgagaacatcatccacaagag

SEQ ID NO: 33578 - DNA, 83 bp, Homo sapiens
  misc_feature 41: w=a or t
ttattacctatttattttttttttactataatacatgatawttagctcttataccacccacttaccactcacctccccttcct

SEQ ID NO: 33579 - DNA, 308 bp, Homo sapiens
  misc_feature 158: y=c or t
  misc_feature 249: s=g or c
  misc_feature 250: y=c or t
  misc_feature 261: r=a or g
  misc_feature 287: s=g or c
  misc_feature 290: r=a or g
cttgcacggggaagagagggaggaaagtagatctgtaggattgagtgaagaaaaagtttgcaagtctggacagaagggaaaagttctcctgagagaccggctttggggaggggaggggggaaggaagagtagctccttcttcttcttctttttttttycttccactcttaaaaagcttctttctcttcacccaagcctcactgtccctctccggctctagctctctccatataaaccctcaagattatsycaattggttaragccagccgggaatttcgtgcgggtsctraaggagctgcgggacccg

SEQ ID NO: 33580 - DNA, 324 bp, Homo sapiens
  misc_feature 73: k=g or t
  misc_feature 74: b=c or g or t
  misc_feature 75: v=a or c or g
  misc_feature 92: n=a, g, c or t
cttccgtttggattgagaaaacttacccaatacctgtaccatcattgttccttgaaagaaaggagtgtgcttkbvatttcagggactcatanggcagaagggccttgtctcagatgagacttttaacttttcacacttgagttaatgcgggaatgagttaaggcttttggaaacttttgaacaggtgtgattgtattttactgtgtgagaaggacatgggatttgggggggtcaaggtcagcataatatgatttggttgtgtgcctctagaaaaactcacttggaattgtaatcccaaatgttggaggtggggcctggtggggt

SEQ ID NO: 33581 - DNA, 175 bp, Homo sapiens
  misc_feature 11: m=a or c
  misc_feature 25: h=a or c or t
  misc_feature 60: m=a or c
  misc_feature 73: k=g or t
  misc_feature 91: m=a or c
agaggagaggmaaagttcaacagghcaacaaagaagcagcagaaacagccaggaaaacgmagagcccccaggktttgacacagaaccctcmaccaagagttctcaaatccccaaatactctgcaaagtgcaacttgacgggaacttttcaactgacttttacttttgacgaccta

SEQ ID NO: 33582 - DNA, 365 bp, Homo sapiens
  misc_feature 2: k=g or t
akcaggggagtcacagcaaggaggggagagccagccagaactgggaaatgatgtaggggcaggggcgttggaggtaggccaggtttcctgctgtccctgcaagagcagaggaggagatcatctgagatccactgagtcagccatccacttgacttcccaagagtctggacctggcctcctaccagggcatctcgttgatggtgtggtccacagtctgccttatatatcctggggctgtggcttggaacatgattatgcttagaacatattgcttagaacacgtttatgttctaagcaatctgaggtacagtcgctaatttaggagcacaaagtatttcctgatttagtattctacttagaaggca

SEQ ID NO: 33583 - DNA, 249 bp, Homo sapiens
acagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccagt

SEQ ID NO: 33584 - DNA, 189 bp, Homo sapiens
  misc_feature 5: k=g or t
ttgtktttttgggttttctttcttgtttgtgttttgttttttgagacggagatttgctcttgttgcctaagctggagtgcaatggcacagtctcggctcactgcaacctctgcctcctgggttcaagtgattctcctgcctcagcctcccaagtagctgggattataggcatgtaccaccgcccggccg

SEQ ID NO: 33585 - DNA, 264 bp, Homo sapiens
  misc_feature 51: k=g or t
  misc_feature 94: r=a or g
  misc_feature 100: s=g or c
  misc_feature 130: k=g or t
  misc_feature 135: s=g or c
  misc_feature 186: s=g or c
ttattatacttttaagttctagggtacatgtgcataatgtgcaggtttgtkacatatgtatacatgtgccatgttggtgtgctgcacccattartttgtsatttacattaggtatatctcctaatgctakccctscccactcccccgaccccaacaacaagccccggtgtgtgatgctccccttcstgtgtccaagtgttctcattgttcaattcccacctatgagtgagaacatgcggtgtttggttttttgttcttgcgact

SEQ ID NO: 33586 - DNA, 128 bp, Homo sapiens
cagatagctagaagagcagattttgaatgttcccaacacaacaaaatgatatatgtttgctatgtgaataaccctgatttgatcattacacgttgtatgcatgtatcgaaatatcacactgtgccccg

SEQ ID NO: 33587 - DNA, 195 bp, Homo sapiens
ttgattttacaggctcatagattgaagggacttgtctcagatgagattttggacttagacttttgagttaatgctagaatgagttaagattttgggtaagacaggtagatcttctgaggtcgggagttcaagaccagcctgatcaacatggtgaaactccatctctactaaaaatacaaaaattagcaggacggc

SEQ ID NO: 33588 - DNA, 100 bp, Homo sapiens
attttggggttgggttgctgtagtaaaactaaaaaatgcagataaagtgtttgccatgaaaatattgaataaatgggaaatgctgaaaagagctgagtct

SEQ ID NO: 33589 - DNA, 224 bp, Homo sapiens
  misc_feature 146: r=a or g
  misc_feature 160: r=a or g
  misc_feature 168: y=c or t
  misc_feature 176: y=c or t
  misc_feature 179: y=c or t
cccaactttcttgtcaccctgctgacttcaatccttggtttttcagtctaaagtgtgcccctcagggcccacactggctccctgaaagcgagagcagctgggacacaactgtccacccttgggtggggagctcagtgaccccaggrgcatgagccctgcrgccaaagytccacaaytcytcccaagaacagctctgacaggtcacaggataaaacaccgggcaa

SEQ ID NO: 33590 - DNA, 250 bp, Homo sapiens
  misc_feature 20: r=a or g
  misc_feature 55: s=g or c
  misc_feature 154: k=g or t
  misc_feature 164: n=a, g, c or t
tccattcattgactactgaraatataatcaggggattataaattgcctccaagtstccatcactatcctgtttggaagagtgaggttgagagcctggtttgggaattgttaacaaaagtaatgacactgatttgggtgaattatgcctaatatkcatgaataanatcgttatgcatgtaaatgtcagactaactttgtatattaaagtttaaatacaaactttattttgcacagctatttagagggaact

SEQ ID NO: 33591 - DNA, 337 bp, Homo sapiens
  misc_feature 96: n=a, g, c or t
catccgaaagaagatatttcaagaggcactagttcaaatcacacttcccactgtgcagaaggcactggcgtccacatgcaaaccagagcttcaganatacgagcagttcatctttgcagatcataccaatattattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttct

SEQ ID NO: 33592 - DNA, 175 bp, Homo sapiens
tcaagatacagtctttgtcctcctgccttaggaagccctccctaaccgtccttattccctgtgaccttacttcttctgaactcttaaaaagcatggactgtctcatgaaggtaccagtcgtttgaaagtgtcacatattacattgtattattaggtccgtcccctaacccccgag

SEQ ID NO: 33593 - DNA, 198 bp, Homo sapiens
cagatcgttcttcatttgacatagtagcaacattgtctgaactcccaagatgtgctttctttcttggaagtagggacaatttctcttccatgtgccccttttcatcagatgtgccttcatccatcaacatttctgagtcaggtatacgtggggtctgaaaattaaaaacctggtcaacaaataaacttgtactacagt

SEQ ID NO: 33594 - DNA, 124 bp, Homo sapiens
cctgctgttatcacctaggctggagtgcagtggcacaatcatggctcactgcagcctcgaaccctccaggctcaggcgatcctctcacatcaacctcttgagtagccgggactacaggtgtgcc

SEQ ID NO: 33595 - DNA, 175 bp, Homo sapiens
ttttttcggaaacaggaaaacgagtcaggggtcggaataaattttagtatattttgtgggcaattcccagaaattaatggctatgagttcttttttgatcaactcaaactatgtcgaccccaagttccctccatgcgaggaatattcacagagcgattacctacccagcgcccgg

SEQ ID NO: 33596 - DNA, 133 bp, Homo sapiens
aaaggacggtcgacttcggcggggcccaggtgagaaaggcccacctgtgtcctggttgagggtctccagggttctttggggcccgaggtgccaatgggtcatgtttggttagaaggtgacaatctacagaatt

SEQ ID NO: 33597 - DNA, 87 bp, Homo sapiens
ttcttttacaaacaataccaacatgtctccaggcttctctaactaggaagtatacgtaaaggaggaattgctagggcatgggattgg

SEQ ID NO: 33598 - DNA, 272 bp, Homo sapiens
  misc_feature 145: s=g or c
  misc_feature 147: s=g or c
  misc_feature 210: k=g or t
agagaaccttatagatatcacagtcttgagggtcaaaaaaaaatacttaggaagctagccatggaagcttcttgcctctgacccagcccactttcccagcctacctctgggccttagctgctaaaaagcttctctggcagcggastsaggcctgaggaaacatgctcagtcatgcacatgtgttgacccatgtttcagatgcagtctgakgccaggtatattgttagggaaagaggaagaagggtaaactgagctagcccctggggctgagt

SEQ ID NO: 33599 - DNA, 179 bp, Homo sapiens
cataagataacaaaagatgctcttttaaagtttaacatggctgggctcagtggctcacgcctgtaatcccagcactttgggagtctgaggcaggtggatcaagaggtcaggggttctagaccagcctggccaacatggtgaaaccccatctctattaaaaatacaaaattagccagggc

SEQ ID NO: 33600 - DNA, 231 bp, Homo sapiens
  misc_feature 82: s=g or c
  misc_feature 111: n=a, g, c or t
  misc_feature 176: r=a or g
attttagtagagacggggtttcaccgtgttagccaggatgggtctcgatatcctgacctcgtgatccgcccgcctcggcctsccaaagtgctgggattacaggcgtgagcnactgcacccggcctacaactagccttaattccctctccagccacctctctctagtctctggccaratcccttactttagccaaatcagtccattcatttttcccaaacatctggcccact

SEQ ID NO: 33601 - DNA, 127 bp, Homo sapiens
agtacagtggcgtaatctcagctcactgcaacctctgcctcccgggatcaagcgattctccttcctcagcctcccgagtagctgggattacaggatggtgctagcatatataagactgaaacaccgc

SEQ ID NO: 33602 - DNA, 187 bp, Homo sapiens
ctttctcatcattccatggggtgtgtctgcctgggccaactctgcatggagaggccagggctggggacagtccgcactctgccaccctcctgccccttccacccaccccagctctatgtctgtgtctgaattgtggatcatgcagccatggttattgtggaactgtggaacctgcagccatagttat

SEQ ID NO: 33603 - DNA, 262 bp, Homo sapiens
tctttctctgaaggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccgcg

SEQ ID NO: 33604 - DNA, 316 bp, Homo sapiens
  misc_feature 3: y=c or t
  misc_feature 163: d=a or g or t
  misc_feature 174: w=a or t
  misc_feature 262: d=a or g or t
  misc_feature 313: h=a or c or t
  misc_feature 315: n=a, g, c or t
agyacgtccccggtgttgtagtaaacgtcgcccgattgccgcacgttgcgcaccagcttccgttccgacagctctcgggggccgcggtagcccacgaagggttgctggcttaccaccttggtcagcagcagccccggctcccctggggtaggagcaggaacadgaacccctggwgcccaccagccaagccccctgctggaggttttcaacaacggtggactcttcatcacccagcaccctgccaaggacagacccaaagacdcagacagggagatccagagatgagagagacattcagagaccttgagagachgnc

SEQ ID NO: 33605 - DNA, 136 bp, Homo sapiens
atgaggtaggtgttcagagtaatattctgcattatagtgaaaaatttttaatattaaaattcaattatatcattttatgaattgtgcttttcataatgcagtacatttcaaaatttttagattatgtatgaacctg

SEQ ID NO: 33606 - DNA, 329 bp, Homo sapiens
  misc_feature 178: n=a, g, c or t
  misc_feature 179: n=a, g, c or t
  misc_feature 271: r=a or g
  misc_feature 272: r=a or g
tttttcctaagatggtgtgtgtggggctgaggtatcacccatgggctgtttactgggaccctcagttcctcgtcctggggtcctgtctggagcattgctgacagaactggaatctcctgcttggtggccctttagctccaagctttggaagacaccaccggaaacaaagcccaggganntgtctccatgaccagttgtgaaccctttgggaaagaagggatactgataaaaattcctgctgttatttcccacagaacagagtctcacgttrraccagggaggctcaccgtccttgtgtctgggttggaaatacatgactccagttcttt

SEQ ID NO: 33607 - DNA, 115 bp, Homo sapiens
  misc_feature 100: b=c or g or t
  misc_feature 101: b=c or g or t
  misc_feature 102: d=a or g or t
caaaaaaataggtaggatgatgggctaggtttgggaggaggctccaaagttaagaagcgaggcttatccttgagatcatggcctttaccacaaccagcabbdtcatcattatgag

SEQ ID NO: 33608 - DNA, 306 bp, Homo sapiens
  misc_feature 63: m=a or c
aaatcaaatttaaggaatcttttacaatgcatactcatcttaaataattgcaaagcatatttmtttaattattcggagttgttaattctgctatacaggttttgtgtgcttctgaaaagtgtggttatcaagttatctagtttttacaactgccttggagtttatcaggagagagaccttcttttttgccttcattttcttcttaccgctgctatactatgctctactgtcattaacactcaattcccactcccttccccagaagcttttgtcataagacattacaaagaagggagattgtgccta

SEQ ID NO: 33609 - DNA, 322 bp, Homo sapiens
  misc_feature 137: r=a or g
tactcacagcagaaattaagggcctatggtgacagtatacacagtcttgatgttagtttatttgtagcactgatggcaaatatctccctacattattgtgtaaaatagaaatgtagaaagcaaacaggcatgctgtrtataaagggcttttaacagggaacttgtagctatcacttataatttgtccttaaattgttaaattttgaaataatttcagatttctagaaaacttacaaaattgtacaaaggatttctgtgtccccttctcaggttctccaaatgttaagttgatcacatttgttttttctctctatgcacatac

SEQ ID NO: 33610 - DNA, 224 bp, Homo sapiens
ttcacgtccttgttgtggtttgcctgagttgttagtgtgtgctttatgcctaaagggaaacatcttgggacatttggggattttctcgtagaacttttctttttaccagctcattcatttctacactgtaagagctgaactagtttaaagtgattctttagatcacttaccttaattttgagtcaagtttttcccagtgtgggcacagaccccaaacttcattt

SEQ ID NO: 33611 - DNA, 185 bp, Homo sapiens
tcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggcccc

SEQ ID NO: 33612 - DNA, 225 bp, Homo sapiens
tattattgccaagatcaagaaggacataacaattttaagggagtggaaatagactctgcttctttgctagggtgtggcaaagttctggaagaacatgtgggactggaaatattgctggggctacttttggaaaattcagactgacacagctgcacaggactaatcagggattagttttgtgaaatttcctgctcccatttctcattttagtcacagcaaaaggag

SEQ ID NO: 33613 - DNA, 406 bp, Homo sapiens
  misc_feature 2: n=a, g, c or t
  misc_feature 14: n=a, g, c or t
  misc_feature 353: r=a or g
anagcttacttttnagctgtgttgtgtgggaccagagcagccttttactgtacagctaattttagctcattactgaggagatgcctttatggaaactttacccaatgtcccatgtgctctcccttctggctgaatgaacatgaactgtttctggttttatgtgagtcctggggattgttctacttgctcttcctagtggctcttctctggacttagactgtcttgacaaagggaacaacctatcttcagcactcgagctcatgtcttccaaattgacccaaacacaaagaagaactgggtacccaccagcaagcatgcagttactgtgtcttatttctatgacagcacaagaratgtgtataggataatcagtttagatggctcaaaggcaataataaatagtacc

SEQ ID NO: 33614 - DNA, 157 bp, Homo sapiens
agaagaaaagttagatttgattgagatttctaaggtagaactgatagaattgagaacctgggtacatagtgatgtctttaccagtattaaagatgaaaagaacaagttttaggaaatgataatgagttccttttaggcctgttaaatttgagtggca

SEQ ID NO: 33615 - DNA, 187 bp, Homo sapiens
taattatttgcatagaaatgtgtgggctctttatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggta

SEQ ID NO: 33616 - DNA, 281 bp, Homo sapiens
  misc_feature 41: s=g or c
agctgataggagtgtcttgcttttgtctgagacttgcggastccccattgcccttgaaaaccctgccttagagcttgacatcatggtatttttatttaccctgctttatgaaagttgaccctttagcttagatttcagggtcaagagaaatcatggccgtacgtgaaaggtagagttggtcgagttgggaagttaatgttgaaaatacagtgtaaatgtggggaggcctcccctagcgcctttctccactgacagagaaaacagaagaaaacagcagccgt

SEQ ID NO: 33617 - DNA, 404 bp, Homo sapiens
  misc_feature 9: k=g or t
  misc_feature 298: d=a or g or t
  misc_feature 299: b=c or g or t
cgatctctktaaagacttaagatttaattctgtatttcaacgcaattttccccccatatgtgattgagtaaaggattttgaaagatatcccatgacaacgtaataaagcttaaaacaagatctgaccgaaaaggaatagggattccacccagggaccctaaagttgataacctttgtgttagcggacattcctcttcctccatgcctcaggccccagtttattttctaccataaaatcatgctctcaatgaagtaattgatatgaatcatttaatttatagcataaatttaagtcatdbagttgtttcaactagaaggatttgcattttatcccttgtcctctattaaagaaatttcacataccctgggagccttaccctcaccctaaaaactacaccaactca

SEQ ID NO: 33618 - DNA, 274 bp, Homo sapiens
  misc_feature 152: s=g or c
  misc_feature 153: k=g or t
tttttccctttgaaattaaatagattacttggtttccaacatttaattttgtctattatcagaaaaagttttcacgtaatgaaattaagcaatataatattaatggaaaacattattctcaggactaattactgcgcacctttgatgtgtasktgtttgcatttactatatgcatgacatactactgtacaatgaatcgcagtgcagagtaatgatgattcaataaatgtagatctattttgcatatttgcacaacttaagaaataccaactgc

SEQ ID NO: 33619 - DNA, 93 bp, Homo sapiens
aattaaaataattatctcagtcccttcttatcaacagagtcgtccatggagactatttctccccctgccccaggcacacagaagccttgaggc

SEQ ID NO: 33620 - DNA, 415 bp, Homo sapiens
  misc_feature 7: n=a, g, c or t
  misc_feature 8: n=a, g, c or t
  misc_feature 9: r=a or g
  misc_feature 83: d=a or g or t
  misc_feature 84: n=a, g, c or t
  misc_feature 85: n=a, g, c or t
  misc_feature 391: r=a or g
atgggannratataaaataaatagcaagatgatagaatcaaacctaaccatatgaatagtcacactaaatgtaaattgtctadnnactccagtttaaaggctgaatttgtcagattggatataaaagcaagatccaactatatgcttgcctacaagaaatagtttgtaaacaaacaggttaaaagtgaaagaatgggaaaagatataatatggtaacctagtcaaaagcaacttggagtggctatattaatattaaagtatatttgagagcaaggaatatttccagggataaagaaggtcatttcatttataatggtaaagaggtcagttaagaggacataatgatgttacatgtttatgcacctaataacagagcttcaaaacacatgaracaaaacctgatagaaatgcagga

SEQ ID NO: 33621 - DNA, 170 bp, Homo sapiens
caaaagatgcaaaataaaaaagacacatactggaagcaaatatttgtaatataattgaccaggaaatagtatctctagtgcctaaagagctcctgtaggctgtggagcagccatccttttattcctttactttcttaataaacttgctttcattttgcactgtggacaac

SEQ ID NO: 33622 - DNA, 337 bp, Homo sapiens
cccatcactcttctaactggggacccaggactcctgcactgccctgttcttaccccctatatcccaatcacctgtactgttagctttcaggttcttattggttcctccactaaggacgggccatgagggcagggaccttatctgcccttcagggcggaattcccagtaccaggcacgcagtaggtgttccataaatgtttgctgaatgactaaaagcccaccccaaggaacaaagaaaaatctctcctttcacacacttcccagggcctgctcagtgccttgctctggaaacagagcttggtgagcttcctggggagggtctctgcctagggcacct

SEQ ID NO: 33623 - DNA, 214 bp, Homo sapiens
  misc_feature 118: n=a, g, c or t
  misc_feature 119: k=g or t
  misc_feature 120: n=a, g, c or t
  misc_feature 121: w=a or t
gagggatctttcagggcacaagaatattgtgggttacattgattctagtatcaacaacgtgagtagcggtgatgtatgggaagtgctcattctgatggacttttgtagaggtggccanknwggtaaacctgatgaaccagcgcctgcaaacaggctttacagagaatgaagtgctccagatattttgtgatacctgtgaagctgttgcccgcgg

SEQ ID NO: 33624 - DNA, 216 bp, Homo sapiens
agaggatctctcaggccctttcccctgatctggcctcctgggaactgcgtaactcagattaacaacaggctctggagagctgaacattgtattacgtgctcactggaaatttggatgtgtctttctgtgaactgcctgcccaggagctatgacatgagctttgcaagtcttcccaaggacctgtttgactggcacctctgtagacccagcagaatc

SEQ ID NO: 33625 - DNA, 118 bp, Homo sapiens
aagctgatacttctagctgagccacaagtgctgcttggaaagggcttaggttgtttccagggggagaactctgcagaggagaggcaaagttcaacaggacaacaaagaagcagcaggt

SEQ ID NO: 33626 - DNA, 177 bp, Homo sapiens
  misc_feature 123: m=a or c
ctccgagttttgcctctctcactggcagcaacccagcgcttccattgctgacctctaccgacctctacctgtggtccttcctctactgcagcagagacactgttttcttcctttgttcttccmaacccccatgggaatatcacagaagtgaagtgcaattctcatcatgtcatatca

SEQ ID NO: 33627 - DNA, 102 bp, Homo sapiens
ttcaatattgtataaacaatagtgttctaattaccttaaaaaaaaataatgaccagttaagaattgcttttgatcttgtcaaaaaactgaatagaccccctg

SEQ ID NO: 33628 - DNA, 311 bp, Homo sapiens
  misc_feature 247: b=c or g or t
  misc_feature 309: d=a or g or t
tctaatttgattatagctacttttatgggagtaaaatgagaaaaatctagcatttagtttaaggggatacttctttttctaagaaatacatcccaccataactggttacttaaaattttagttattcagcttaggagaaactgtgtgcagggaagtactgccacttggatgacaatagacggtgtttctgtactatatgaagtactaagtagttgtggtagccatgattctgagcaactgttgccabataaagtttcttttttaagaaaaacttgcccctgtatttgaggagataattgcttgagaagdtt

SEQ ID NO: 33629 - DNA, 189 bp, Homo sapiens
  misc_feature 35: h=a or c or t
tcatctaaatatttccatattctgtattaggagahaattaccctcccagcaccagcccccctctcaaacccccaacccaaaaccaagcattttggaatgagtctcctttagtttcagagtgtggattgtataactcatatactcttcgatgtacttgtttggtttggtattaatttgactgtgcatgac

SEQ ID NO: 33630 - DNA, 105 bp, Homo sapiens
ccagaaagtcaggggtctataaattgacagtgattagagtaatactttttcacatttccaaagtttgcatgttaactttaaatgcttacaatcttagagtggctt

SEQ ID NO: 33631 - DNA, 209 bp, Homo sapiens
  misc_feature 131: w=a or t
  misc_feature 132: v=a or c or g
ttaactaggccaagtggtggagaaccagtagggtaggaagaaggatttggatgtggaaaaaatgctgaggtgtgggattcttggcaggttagaggtgtaagtcatggccagtgtgtctagtcaagaaagawvgagatgatgtcagatgtagggaggattgagaaggaagcaaaggaacagactatacaagttcttatgagccatgtcca

SEQ ID NO: 33632 - DNA, 267 bp, Homo sapiens
tatctgggctaaacttttctgttttctctatttttttattcttattcctgtctcattcttagcatcagttctaaccttgctcttatctcttaattcattcctgatcttaattctgagtgttcttaatttaggtcaacatggattgtccaactttagataaagattataataaggataaagaaaatttggagaaacagatgatacagaaagaattccatatgtatctcctctcaattctgatgatttctgccacacagtttctgacac

SEQ ID NO: 33633 - DNA, 130 bp, Homo sapiens
aattcaattcaatactgacaaactttagcttgtagttttacagtacatttatttttaaagaaaaagaaaacaaaagccagacaaacccaagttgtccaggcaaataaactcaaatctttgtcacgtctgc

SEQ ID NO: 33634 - DNA, 311 bp, Homo sapiens
  misc_feature 23: k=g or t
gtttttgtttttcaataggcagktaaacatgaagccattgtgaagaatgtacatgatctcctggcaaaattggcatgggatttttctcctgaacaacttgatcatctttttgattgttttaaggtaattgttaacatagcaaaatattaccattctatttcaaatagaattgattaattagatctgtgaattacttttagccaataaatacttaaatagaaatcccattaaacagtctgtggtgtgaaggaattggcccattgttttcttttccaacaagaacttgatgttcattttcttaatagccccgc

SEQ ID NO: 33635 - DNA, 160 bp, Homo sapiens
  misc_feature 79: r=a or g
  misc_feature 80: k=g or t
  misc_feature 81: m=a or c
  misc_feature 145: n=a, g, c or t
  misc_feature 146: d=a or g or t
  misc_feature 147: m=a or c
ggatgtgagggcgatctggctgcgacatctgtcaccccattgatcgccagggttgattcggctgatctggctggctagrkmggtgtccccttcctccctcaccgctccatgtgcgtccctcccgaagctgcgcgctcggtcgaandmgacgaccaccccc

SEQ ID NO: 33636 - DNA, 158 bp, Homo sapiens
  misc_feature 158: m=a or c
attctggggccggcgattgcagtgcgagctcagggtgttgctcgcagtaagatgagtactctaaacggaggccccaaagatgtcaaaggaaaattttgtgaggaccactgtatactacagcactctaaccgaatatgtgtcatcacattggcagaagm

SEQ ID NO: 33637 - DNA, 105 bp, Homo sapiens
  misc_feature 45: w=a or t
tccctctccccacctcacctctgaggactatgatttggtgtttcwgtccttgatcagatgaccctggcaactctgaatgaatgtgcctgagttgacttcactgcc

SEQ ID NO: 33638 - DNA, 186 bp, Homo sapiens
  misc_feature 9: h=a or c or t
aacacctchcatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgttgtttctttttttttttttt

SEQ ID NO: 33639 - DNA, 124 bp, Homo sapiens
  misc_feature 98: k=g or t
aatgatgcgtacgattagggattgtcaagtggaggagcccgtggagcgtgaggctggggatgtcctaccggcggtcgacaggagcctgcaacccaggkaactgtttatgctgaggatggaaggg

SEQ ID NO: 33640 - DNA, 157 bp, Homo sapiens
  misc_feature 75: k=g or t
  misc_feature 76: k=g or t
  misc_feature 118: w=a or t
aaactgggtgacagagtcagaaaactccccagctaaacacccgtaagacttcatacaacacaatactctatactkkgatgatcacagctgccaaggctacctaaaagaagacagttawtctcatatttggctgccagctttttatcttcctctcgac

SEQ ID NO: 33641 - DNA, 301 bp, Homo sapiens
tagtattggagaatgttgaatttgaaattcttttccaaataaagagatgtagtaggcagttggatacatgagacaggagttcagaggaaggattaggactggagattcaaactctgtttttatttctgcatatgtattttctttacagcataagcctacagggtacgaagaatgaactctgagaatgtttggaggtaaatatacatgtcccatattatatgatgatgaacatgcaagtactggtctcaattcagtctgctattttttaaaattccctgatatacattgcaaagaggtacct

SEQ ID NO: 33642 - DNA, 164 bp, Homo sapiens
taagaaaaaatcaaatcgaagtcagcctgctggaaaagtgatcacatggcagttgcagtaacttgtatggaaagagaaaatgcaatgagcccagttactgcacttgccactaccatgctgtccatggaacgaataatcagcagttcagttgtcacaagccgccc

SEQ ID NO: 33643 - DNA, 249 bp, Homo sapiens
  misc_feature 126: k=g or t
  misc_feature 127: v=a or c or g
ataaactggcatgttctgaaagaatcactctggatgctgtgtggagaaaacactgaaaagggggagaataattgactccattcaagtgttcgctcctgtttcaatcaactatggctgaagagtgakvagacatttggaataaatatggcttctgggggcccattcctatggatcagcagctggcttctggaggcccattcctgtgaatcgtcgatctcatagaagataatattgttagaaggcataccc

SEQ ID NO: 33644 - DNA, 178 bp, Homo sapiens
cagaatttcatgtgatagaacacttaaaagtctgcctgtgcacatgtatgaatatgcattagggagaagtaaaagagtgacctgaaaatcttcctaaagtaatattatctagaaagtttgagaggtttaactgtggctaacaagatttcctgaagataaaatgttcctggggccttgg

SEQ ID NO: 33645 - DNA, 191 bp, Homo sapiens
taatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctg

SEQ ID NO: 33646 - DNA, 189 bp, Homo sapiens
  misc_feature 48: r=a or g
  misc_feature 103: d=a or g or t
  misc_feature 104: v=a or c or g
gaatatttattcatggcgattaattaaattatttgcctaacttaagaraactactgtgcgtaactctcagtttgtgcttaactccatttgacatgaggtgacdvaagagagtctgagtttacctgtggaatatgttggtttattttcagtgcttgaagatacattcacaaatacttggtttgggaagac

SEQ ID NO: 33647 - DNA, 328 bp, Homo sapiens
  misc_feature 276: n=a, g, c or t
  misc_feature 277: h=a or c or t
  misc_feature 278: n=a, g, c or t
  misc_feature 279: n=a, g, c or t
caaacacttatttacatggttccttgtgttgagtactgttccctgtgggtgccaggggcagaattggatacttgtgtctgcctttgaggggctttcaatatagtaagggaggtaaggaggtaaacaaagactgtaatagaggctgaccagggtgttggcaaacagaagaagcagtatgtaactttagagtcagagatgatttcataaaggagcagttacgaggggcagagttcaggtagacaaaatgagaaggaaagaacatgcaaacagaataanhnnaatgtgcaatagtataatgtaatttgcaagaacatggctggttcgggga

SEQ ID NO: 33648 - DNA, 253 bp, Homo sapiens
tatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttt

SEQ ID NO: 33649 - DNA, 126 bp, Homo sapiens
ccatccgggagagcatcctcatcaacaacggctcccggatcaaaggctggtgggtgttccatcactacgtgtccaccttcctgtcgggagtcatgctgacgtggcccgacggtctcatgtacacag

SEQ ID NO: 33650 - DNA, 174 bp, Homo sapiens
  misc_feature 30: r=a or g
acacattcaaaagctagcagaaggcaagarataactaaaatcagagcagaactgaaggaaatagagacacaaaaaacccttcaaaaattaatgaatccaggagctggttttttgaaaggatcaacaaaattgatagaccgctagcaagactaataaagaaaaaaagagagaaga

SEQ ID NO: 33651 - DNA, 436 bp, Homo sapiens
  misc_feature 7: w=a or t
  misc_feature 338: d=a or g or t
  misc_feature 353: k=g or t
  misc_feature 362: n=a, g, c or t
caataawttggtaaacgtgtttccctgagttctgtgagctgcaccagcaaattaatcaaaccccaagtggaggttgtgggaaccccaacttgaagccagttggtcagaatttccagacacccagagttacaactggtgtctgggaggtggggcagttttggggactgagcccctcgacctgtggcatctaacactatctacctggagacagtagatagtgggcaacatggtgagacccactatctccaagtagatagtgtcagaataaaactggaggacacctacttggtgtccactgcttagcgtgtgggaaaaactctcacacatttggtcacagdagtcttcttatgtgktgatgattnttgttatgttagtatgagagcagaggaaaaatggtttagagttttttcccaaacagtcatgtaatgctatcata

SEQ ID NO: 33652 - DNA, 136 bp, Homo sapiens
  misc_feature 97: m=a or c
  misc_feature 99: y=c or t
taggtgatattgttcttccacatttattgatggtgaaattgattgttgggtttggatgtgttgacttgatcccaccattataaagttccccgtaaamcytttttctctagccttgtaaacatccatttatagccgc

SEQ ID NO: 33653 - DNA, 315 bp, Homo sapiens
  misc_feature 289: r=a or g
taaggacagcagcaattatttaataacatagaactgatcaaaatgtagatagagtttccgaataacaaattgagtatacgtgtagatagaaatacagatacagcatacatacatactatatgtatttagaaaacacatatgtttacatatgtaattaagaaaaaataggccgggtgcggtggctcatgcctgtaatcccagcactttgggaggccaaggtgggcggatcacctgagatcgggagttcaaaacccgcctggccaacatggtgaaaccctgtctctactaraaaatacagtaattagctgggcgtgt

SEQ ID NO: 33654 - DNA, 230 bp, Homo sapiens
tttcagggagaagagaaagcaggtgcacaagccctgaggcccctcgcaagactctcggtgtttggggagcagaagaaaagatcttatggaaggaagcacagtgtcagggagatggtagacgtaaggtcagagaggttggcagggcatgcccctaggggatcttgtttggattagaccttaatcgtgtctagaagccattttgttcttttttttttttttttttttttttt

SEQ ID NO: 33655 - DNA, 128 bp, Homo sapiens
ccattttcgtctagcagtggaagaagactgaatatctcgtataccagaaacatgactcttaaagatggtaaaaacaatgtagccatagctgtaacgtataaccatgatgggtcttatagcatgccgga

SEQ ID NO: 33656 - DNA, 391 bp, Homo sapiens
  misc_feature 17: h=a or c or t
  misc_feature 283: n=a, g, c or t
  misc_feature 284: n=a, g, c or t
  misc_feature 285: n=a, g, c or t
  misc_feature 319: n=a, g, c or t
  misc_feature 320: n=a, g, c or t
  misc_feature 347: n=a, g, c or t
cattagcaattttttthttgagtgcctactatataccgtgcactgttctagggaatgaggatatagcattgggcaaaaaagattaaaaaaatttctcccttgtgtggagtgtaccttctggtggagaaaggctaaccaaataaataagtaaatagcatattaagtaatgatagttttctggagaaaagcaggaaagtggaataggagaggtttcagttttaaacaaaatgatcagacgaggtgacatttgaacaaatatttgaaggaggtgaaggaataagcnnngcctagaacattctaggcaacagaaatagcaagnnaaaggccctgaggttggagtgtgttanggcaagtgaggaggccagtgagattggaatgaagtgagggggca

SEQ ID NO: 33657 - DNA, 217 bp, Homo sapiens
cactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccacc

SEQ ID NO: 33658 - DNA, 269 bp, Homo sapiens
tatttttctaaaaacgtgttttggatcctgtactctaataaatcataagtttctttttaaaaattttccaaaacttttctccattttaaaaaggccctgttataaacgttgaactttcacaatgttaaaatgttaaatatttggatatagcaacttcttttctcttcaaatgaatgccaagatttttttgtacaatgattaataaatggaacttatccagagaaaccacgcaaatgccctgcccaatttcgtttgaggacagaaagccc

SEQ ID NO: 33659 - DNA, 141 bp, Homo sapiens
  misc_feature 93: r=a or g
tgaattacatagcatgttgttgggattttttttaatgtgcagaagatcaaagctacttggaaggagtgcctataatttgccagtagccacagrttaaagattatatcttatatatcagcagattagctttagcttagggga

SEQ ID NO: 33660 - DNA, 195 bp, Homo sapiens
  misc_feature 112: k=g or t
agcctaggtggaagggtggcttgaacccaggaggtcgggctgcagtgagctatgactgtgccactgcactccaacccaggtgacggagcgagaccctgtctcttaaaatatkttttttacagtgcattttcatgtgtttcaacctcctagtgtccctgccaaaaatattttaatctgaatcaaatcatgggaaac

SEQ ID NO: 33661 - DNA, 330 bp, Homo sapiens
  misc_feature 301: m=a or c
  misc_feature 302: v=a or c or g
agatgaggattcaggaagcttgaggtttaggaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggmvggtaaggagactgatacgaagggagtcc

SEQ ID NO: 33662 - DNA, 377 bp, Homo sapiens
ccaaggctctggttctttttagtaaggaatgtatttagaaactaaaatcattgccatgggttgtcattgcttctagaccctttcagtggacagaactaagaaatatgtttaaaaagaaccgtgagttcatgttatttctgattcagatgtaatattagagagacttttttctgactctgttagccttttaattttccaaatctaagggaccttgtcggtatcatggccccatcaaattgagatacacattgttacttaaataggcagataaatagtttcatccattcattattgagcatgtactctgttctaggtattgtttggggatacagaacagaatcaaatgcataccttgcttccagaagcttgtagtcttt

SEQ ID NO: 33663 - DNA, 232 bp, Homo sapiens
tggctgtttggataggatacgattagctacaggttttgaatttcttctaattgcagcatggctttttttatttttgctgcggatctcctatttacaatggactccattatgagattcttcttctttgttggtgtattaaataaacatattaccttattttaagtttcgataaaatactgtggaagactttgccaaattttatatgattgtgacaagttttttggggtaggat

SEQ ID NO: 33664 - DNA, 67 bp, Homo sapiens
  misc_feature 12: k=g or t
  misc_feature 13: k=g or t
  misc_feature 14: r=a or g
  misc_feature 21: k=g or t
  misc_feature 22: r=a or g
atcttctcctckkratataakratcaaggccgaatgtaatgaaattcttagttaaaaaggggccacg

SEQ ID NO: 33665 - DNA, 307 bp, Homo sapiens
  misc_feature 44: n=a, g, c or t
atggattttcacaggaacaagggcaggctgaaacaaagagatanagaaactgaggctcaatgaacttgtaacgctttagtgtcagagctctagaatgggtgaaggccagattcagacccaggcatcgtgactcccaagtctgcttgtggatccttgaaagcaagggtgagccataagcattgcacctttgagagaactggtcaaggctcaattggaataatctggagaagcttttctacaatgtctacactccagggcccacacctgccaatgaaatctgtaccttaaacctgaagaggaccaggta

SEQ ID NO: 33666 - DNA, 85 bp, Homo sapiens
aattttgacttaacaaaaagaaaaaataacagattttaaatcttgggtttattcattttgagcacccaaaacctctttttttttt

SEQ ID NO: 33667 - DNA, 227 bp, Homo sapiens
  misc_feature 31: k=g or t
  misc_feature 32: r=a or g
  misc_feature 112: k=g or t
ccttcgtgaaaagcagtttcaacctttatakraaactcacatatgaacatgtcttaagtgcaataaattattgctttcaatggattgtgcatctgaaaatattcaaatattkatgcacatttctcctgccacaagttctaaattggagaaaaataaaaacaaaacagttttccaatatttcacattcaaatttaattactcagtaatttaaaaaaattccatccaca

SEQ ID NO: 33668 - DNA, 238 bp, Homo sapiens
tatgttctattctcagcagatgaattgcatgccttccatatcagaatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgc

SEQ ID NO: 33669 - DNA, 412 bp, Homo sapiens
  misc_feature 100: k=g or t
  misc_feature 199: r=a or g
  misc_feature 360: n=a, g, c or t
  misc_feature 361: n=a, g, c or t
ttgcgttcatccataccacaaagtcataaagagcatattttagagcacagtaaaactttgcatggagtaaaacattttgtaattttcctcaaaagatgtktaatatctggtttcttctcattggtaattaaaattttagaaatgatttttagctctaggccactttacgcaactcaatttctgaagcaattagtggtaraaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcnnttttatacatgtatttttgtatcttttctgtgtgtaaacatagttgaaatc

SEQ ID NO: 33670 - DNA, 297 bp, Homo sapiens
  misc_feature 36: s=g or c
  misc_feature 59: k=g or t
ccaaactgatcttgtgtctgctttgaacttctccastccattctccagctggcagccakaatcatctttttcaaaacacagttcaactctgtcccactctgcttaaactccctcagtagcttcccattgagtttcagataaagcccaaactcctatccattcttcccaggtgtgatggggcacccgtgcctccagcctcctcattcccacttttctcactatgttggctttcgtttaggtctctgaaccctccaggctcctctggccacagacttgccacctggctagctccctcaa

SEQ ID NO: 33671 - DNA, 142 bp, Homo sapiens
  misc_feature 12: n=a, g, c or t
  misc_feature 87: n=a, g, c or t
ttagtctgaaanagattctgcctttttgttttgttttgttttcttgagatggagttttgttcttgttcccaggctggaatgcaatgnctcaacacaacctccacctctcgggttcaagcgattctcctgcttcagcctcccc

SEQ ID NO: 33672 - DNA, 73 bp, Homo sapiens
cagctttgaatgaggcccaacacaaattggtaaactttcttcaaacattatgagatttttttttttttttttt

SEQ ID NO: 33673 - DNA, 260 bp, Homo sapiens
  misc_feature 133: y=c or t
  misc_feature 134: y=c or t
  misc_feature 135: y=c or t
attctcgctgcctgctgccgtccatgtaagaccggacttgctcctccttgacttccgccatgattatggggcttccccagccaagtggaactataagtccagttaaacctttctgttgtaaattgcccaagtyyycgggtaatgtctttatcagcagcgtgaaaacggactaatacagatgcccatggcctgctctggaaaacaattgcttatcgaactctacaccaggccaagggcactgagccatccgcccccagcac

SEQ ID NO: 33674 - DNA, 130 bp, Homo sapiens
ttttgcttgagccagaagagcagcaaaccacagcaggtttgcctgaactatgctttaaccaggcaatattgagagcccggcaaaatgtgtctggataactggcttcggtggtccactttttttttttttt

SEQ ID NO: 33675 - DNA, 382 bp, Homo sapiens
  misc_feature 140: y=c or t
  misc_feature 148: w=a or t
  misc_feature 153: s=g or c
  misc_feature 155: r=a or g
  misc_feature 157: y=c or t
  misc_feature 174: r=a or g
  misc_feature 181: d=a or g or t
  misc_feature 360: v=a or c or g
  misc_feature 361: v=a or c or g
aaaggaatccgggaagcccggcagcggccggtgaggagagagcggggtggggggcaggggaactgggagtggccccggtccgagggaggtaggaaggccgagggtggccagggtcccgggtgacagggagcagacttgcyccaaagtwagggscrtytgaggaaacgctcggarggggttdgggaccctcctgagaaaagcggctgtccaagggagggggctcctggagagatgaggagcagcaggtcttcggagggtcggacgagtagagatcttgcaccgcctgggggaagaaccggagctccctgcgcccccatagctgagctgggatgggagacccaactggcctggccgctccgvvtctgaggatccctaagggacc

SEQ ID NO: 33676 - DNA, 70 bp, Homo sapiens
agttcgagaccatcccggtgaacacggtgaaaccacgtctctactaaaaatacaaaaaaaaaaaaaaaaa

SEQ ID NO: 33677 - DNA, 261 bp, Homo sapiens
  misc_feature 123: m=a or c
  misc_feature 125: m=a or c
  misc_feature 130: d=a or g or t
  misc_feature 134: m=a or c
  misc_feature 138: m=a or c
tatgataaagaagatgctaccaatgaaatagaaaaccaacgagatgagaagactgtgatcctcatgtactcagaggcacttccctcctaagtcaaagaccatcctcactgactatgtgccaamgmctcgdttcmaggmttgtgactcaacaaagggcttttccattgatagaagcagtttgggatttgtagttgcgacttcttcgatagttacctgcacgtccattgctggcaactgacttgtcattaaaacctggctccg

SEQ ID NO: 33678 - DNA, 68 bp, Homo sapiens
  misc_feature 19: m=a or c
  misc_feature 46: m=a or c
  misc_feature 47: w=a or t
tgattctgctgtctcagcmtcccaagtatctgggactacaggcacmwtgccaccatgcccagctaact

SEQ ID NO: 33679 - DNA, 437 bp, Homo sapiens
  misc_feature 204: d=a or g or t
  misc_feature 205: n=a, g, c or t
gaaaggtggcggtgctttcggagggttagaacctgcaaatgaagaacacaatgtggaaacagctgaagattctgaaataagatacttatctgcagattcaggagatgccgatgattcagatgcggatttgggttctgccgtgaaacagcttcaggagttcattcctaacatcaaggacagggccaccagcacaatcaagcggadntaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctcctgtacacggacagatatcctgaggaaaaatctgtgatcaccaacttaaaaaggagatactcgtttagattacacattggta

SEQ ID NO: 33680 - DNA, 125 bp, Homo sapiens
ctccacgattcccaaactggggtacatgtgcttatgctggggattccccagaacctcagggaaaacaaggtacattttccttaagagcactttttgactcagacagcaatatttttttttttttt

SEQ ID NO: 33681 - DNA, 296 bp, Homo sapiens
attttctgctgctgttaccctgaacctttctaaaagtgcttcaagccattgatattttgttttccagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctccttaa

SEQ ID NO: 33682 - DNA, 184 bp, Homo sapiens
  misc_feature 142: w=a or t
  misc_feature 150: y=c or t
tgaaccaccgtgcccggcctgctttatatatataatattaattgttgggtgtttttaaagctccatgcaaagaatggatctgctttaggaaaagccttttgaataaaagtactcactttttccaggaatttacattaacaawtttatgtycttctaagagacattactaataatatctgcaaag

SEQ ID NO: 33683 - DNA, 71 bp, Homo sapiens
tcctggcgacagagggagactccatttaaacaaacaaacaaacaaacaaacaaacaacaacaaaaaaaaaa

SEQ ID NO: 33684 - DNA, 315 bp, Homo sapiens
  misc_feature 16: k=g or t
  misc_feature 98: r=a or g
  misc_feature 133: m=a or c
  misc_feature 149: s=g or c
  misc_feature 156: r=a or g
  misc_feature 222: k=g or t
  misc_feature 223: r=a or g
  misc_feature 305: s=g or c
ctagtttttggctackatgaataatgctcctatgaatgttccccacaagtttttctgtgaacatgtgttttcatttctcttgggttgatgcctcggartgaaattgctgagtatagtaaagtttatggttaamcttttaaagaaattgscatactratttccaaagtggctataacattttatattcccaccagttatgtataaggattccagtttctccakrtcctcaacaacacttgatgtcaatcatttttgtagtagtatctcatttgaggtttttatttatattttctaatggtgttgascccttttcat

SEQ ID NO: 33685 - DNA, 87 bp, Homo sapiens
  misc_feature 15: r=a or g
aatattgtaactgtrattgaggtgtgtaaatgactcatatcttaagtagaacaataaaaatgaatcgatcaggctgcgtgcagtggc

SEQ ID NO: 33686 - DNA, 71 bp, Homo sapiens
cttctagtgctcactgttgctattttgtcggcaagaagatgattctatttttatttttatttttttttttt

SEQ ID NO: 33687 - DNA, 208 bp, Homo sapiens
cgtttgataaaaaaagttaaaaattcatttgattaaaaaaaacatttattatctactccatgccaggccccttgacaggttatgagatcacaaagtccagttggatcttgttgaggtacagcctgagaggagaacatgaataggctggaatttccttcattgtgttcgttctctgaggatgacttatctgtcctccaaagtgacccca

SEQ ID NO: 33688 - DNA, 73 bp, Homo sapiens
  misc_feature 54: m=a or c
ggggccgaggctggcgggcgcggggaaaatggcggcggcggcggcggcggctgmagctacgaacgggaccgga

SEQ ID NO: 33689 - DNA, 438 bp, Homo sapiens
  misc_feature 140: w=a or t
  misc_feature 171: n=a, g, c or t
  misc_feature 172: r=a or g
  misc_feature 308: k=g or t
agtgtgtgtctgtgtgtgtgtgtttacatgtttcctataatcatttgtcttgctttttgagggcattccaactactggtggaaaaaataaataaatacaagggggtccatgctgtgagtagttgaaatgaaaatactggwgttttgatgggattaattcagtacatttatnrtagactaattcacccaaaatcaacttctaaaaccagtttgccttaactcacttaactcaatttcagttagcctgatgactattgcatctaatgttgaaaattcagaattaaaaatgaaatattggctggatacagkggctcatgcctgtatcccagcactttgggaggctgaggcgggtggataatttgaggttgggagttcgagactagcctggccaacatggtgataccccatctctactaaaaatacaaaaattagccaggca

SEQ ID NO: 33690 - DNA, 122 bp, Homo sapiens
ctggattataacatggacaaatcttattttgcttaatgtgtttgtgtgtgtgtagtgtgtgtgtgtgtgtatgtatatatatatatataaatatctttcccaatatgccccgttgacagtgt

SEQ ID NO: 33691 - DNA, 352 bp, Homo sapiens
  misc_feature 158: w=a or t
  misc_feature 251: d=a or g or t
  misc_feature 315: w=a or t
  misc_feature 316: r=a or g
cactaaatctaaatctataaaagcaaaaaggattgaaaggggttagaattataattgagacaaaattgtacattaaattaataaaaggactgttggggttctgctaaaacacatggcttgatatattgcatggtttgaggttaggaggagttaggcawatgttttgggagaggggtacttaattataaaatattgccttctattcagcagaccttccccaccctcctttaacttattcaggctagccaacdgaccttcctcctgagaggcttgttggttctgattctattcagttttacccctaatttagaattwrattttattatgatttggtgtcattttaccaagggga

SEQ ID NO: 33692 - DNA, 169 bp, Homo sapiens
actccattttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggta

SEQ ID NO: 33693 - DNA, 330 bp, Homo sapiens
  misc_feature 124: h=a or c or t
  misc_feature 127: y=c or t
  misc_feature 132: y=c or t
  misc_feature 135: k=g or t
  misc_feature 139: m=a or c
  misc_feature 305: m=a or c
  misc_feature 311: r=a or g
  misc_feature 312: s=g or c
  misc_feature 325: m=a or c
atattaagggatcagaaaaatattctagagaggtgtgtctgctccccgttttcccccaacactgatttccccaaatttggagacaaactactattatctcaaagaaccgcttttcctttagaahcayaggcycckttamctaccctttttcattagccttactttcctcttgcattttatccctccaaatagaatcttttgtgcttctctagggagattccctttgtgttgaattttatgagtagtgtaaattgtgtgggttgcatcataaaacaaagtgcgaacacacacacaaagtcttattmgatgarscaagttcctaagmactgt

SEQ ID NO: 33694 - DNA, 309 bp, Homo sapiens
tttttagtagagacgtggtttcaccatgttggccaggatggtcttgatctcttgatcttgtgatccgcctgccttggcctcccgaggtgctgagattacaggcgtgagcgctgtgcccggctggtctcatttttaccaacacttggacacctctagtacttggctttacaagccctagactttatcatccaagttaacacaacagaccctgttgtcctggcctcaggacagccatcatcctgcttggctaaaaataaaggcagcactcatatagtgtagaattagtattcctaccatgagcaggggcac

SEQ ID NO: 33695 - DNA, 345 bp, Homo sapiens
aaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagaaatactttgctgacccctgcagtagctgaatggagaggatctttgagatgggcagagctttttcatatgagtccaacaaagcaatgaagacctcaggaaaatcccgaac

SEQ ID NO: 33696 - DNA, 359 bp, Homo sapiens
cctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccgact

SEQ ID NO: 33697 - DNA, 287 bp, Homo sapiens
  misc_feature 48: r=a or g
  misc_feature 203: m=a or c
  misc_feature 260: s=g or c
  misc_feature 261: k=g or t
ctctctggactgtaagcaatatgtctccagggccagtgtctgctgcgrtcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaamgaaaacatcacctctaaacttcaagaagcagcctgtttctcttgaccgtgcacaaaskctcctactatgagtatgactttagaa

SEQ ID NO: 33698 - DNA, 254 bp, Homo sapiens
ggaatatcattgaatctttaaattgctttgggcagtatggccatttgtaaaatacttatttttccaatttatgagcaacaaatgtttttcatttatttgcattatctggtttattttagcaatgttttgtcattctacttgtagaggtcttttacctccttgattagctgtattcctaggtattacattttccttgtggctattgtaagtgggattgggttcctgatttcactctcagcttgaacttttttttt

SEQ ID NO: 33699 - DNA, 331 bp, Homo sapiens
  misc_feature 123: d=a or g or t
  misc_feature 124: s=g or c
  misc_feature 125: r=a or g
  misc_feature 189: v=a or c or g
  misc_feature 319: r=a or g
  misc_feature 320: r=a or g
aagtaatatctttttgctttcagttgatatcaggtaatcagccagttttttttccagtttttatctcttcatacttcagtttatggatagttgtgctctagctacaatgttggaacatatagdsrttatgtagtataaagtgtcacttagaaccctcattcaggtttttacagataaaatatatatttvatgcccactaccatttttatgttgatatggactttccagttatttgggtcatctggaattcattttctctaataaattcctcaggaagagcttatgggaacagtattccttgtgttcccctatgtttgarragtttgtctgc

SEQ ID NO: 33700 - DNA, 144 bp, Homo sapiens
  misc_feature 97: w=a or t
gttctttgcctatgtttcctttagctctttgaatatatttaagacagttgttttaaagcaattttctagtaagttcaatgtctagacttcctcaggwatagtttctttattttatttctttaaataggccatacttcgctgtct

SEQ ID NO: 33701 - DNA, 60 bp, Homo sapiens
cttctagtgctcactgttgctattttgtcggcaagaagatgattctatttttatttttat

SEQ ID NO: 33702 - DNA, 57 bp, Homo sapiens
agttcgagaccatcccggtgaacacggtgaaaccacgtctctactaaaaatacaaaa

SEQ ID NO: 33703 - DNA, 129 bp, Homo sapiens
  misc_feature 104: v=a or c or g
  misc_feature 108: r=a or g
  misc_feature 109: n=a, g, c or t
  misc_feature 112: w=a or t
  misc_feature 118: m=a or c
agaagatggtgaaatagacgatgcaggatttgaagaaatacaagaaaaagaagcaaaagagaatgaaaagcagaaaagtgagaaagcctacagaaaatcaagavaaarnacwtaagamagagagagaga

SEQ ID NO: 33704 - DNA, 118 bp, Homo sapiens
ctcagtctttctgtacagtgtgtgtggttcaaatctgaatcctaaacctgaatctcatagttggctgttattcctcatttgaggcaatagggatagcattatcccactatgaatgcct

SEQ ID NO: 33705 - DNA, 187 bp, Homo sapiens
taactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgcccct

SEQ ID NO: 33706 - DNA, 98 bp, Homo sapiens
  misc_feature 15: k=g or t
caaagttttgacttkactagagtttcgcgaacaatttcttttaccaatttacactctcaccagacatgtatgaactagctacattttttttttttttt

SEQ ID NO: 33707 - DNA, 297 bp, Homo sapiens
aatattgtaactgtaattgaggtgtgtaaatgactcatatcttaagtagaacaataaaaatgaatcgatcaggctgcgtgcagtggctcacgcctgtaatcccaacactttaggaggtggaggtgggtggatcacctgaggtcaggagttccagaccagcctggccaacatggtgaaacccgtctctactaaaaatacaaaaaattagccaggtgtggtggcaggcacctgtaatcccagctacttgggaggctgaggcaggagaactgcttcaacccaggaggcggaggttgcagt

SEQ ID NO: 33708 - DNA, 282 bp, Homo sapiens
  misc_feature 14: k=g or t
  misc_feature 15: k=g or t
  misc_feature 247: r=a or g
tttgcagagttgtkkactatgtatacacactcagtagaaacaaaaattggaaacagtcagtgcccaccatcaataagtaatggttgaacacactgtggtataagcttagactattttagcttgggctattttgcatgattagggatgttctggccaggtgtggtggctcatgcctgtagtcccggcactttggggggccagggcgggcggattgcttgagctcaggagtttgagaccagcctgggcrgcatggtgaggccctgtctctactagaaatacaaa

SEQ ID NO: 33709 - DNA, 173 bp, Homo sapiens
tgaaaagaaaatttattaaagaagttatgtaactagccagtaaaagaagaaaaagtttaaccttgcaaataattagagtattcaggacttagtagaaaagctacaatgataaagactgtattggtaggccgggtgcagtggctcacgcctgtaatccgagcactttgggaggc

SEQ ID NO: 33710 - DNA, 365 bp, Homo sapiens
ctctacattttacagatgggggaaggaggtccagagatgttaaatacttgcccaaggtcacacagaaagtggaacactgggatttgaacaaggttttggttgggcatcttttcctatgggagctcagaaatatctgttgtctagccctttctcagcctcccaaccttctcggttccttacctatgtcacagctgactttgagctaaagtcatctcggggcagctaggtgcctatgtgagctggcgttcatttctcactgtttctccttccaaatacctccaggaagaaaagcaagtcctttttgatccaagacattaaaaaagccaggctcagcggctcatgcctgtaatcccaacacttgggga

SEQ ID NO: 33711 - DNA, 158 bp, Homo sapiens
cagttttgttcatttgtgctcttaaagcctacaaatcatagtattttcaactaataaaaagcaaaatttagtgtgctcttattttaacaacatgtaaatttgcaagttttattttttaggaaattaatacaatatttagcttttgtttctaggctacc

SEQ ID NO: 33712 - DNA, 216 bp, Homo sapiens
  misc_feature 154: k=g or t
  misc_feature 155: k=g or t
gcaaatagtgcttggaatggctgcttaattagctttgaatggcttttccttccagctcaaacaatctgtcactaccatgtggtataaaggagccatgcataaaaaagtaagcagaggctaaatatcaatttgattttgtgtagcaaaggaatakkttatttttctccctagtaatgaaacgtatcaatttaaataataaaaggtaaaaacacacac

SEQ ID NO: 33713 - DNA, 288 bp, Homo sapiens
aacctatgttgcttcatattcctgatgcagcaattgtttaagacatggctttaaagaggactgcaagagagctgtgagtgacacatgatgctgtgaacctcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaattgttcagaataaata

SEQ ID NO: 33714 - DNA, 286 bp, Homo sapiens
  misc_feature 58: w=a or t
  misc_feature 59: k=g or t
tctcctgacctcgagatccgcacgcctcggcctcccaaagtgctaggattacaggcawkagccacagcgcctggcctgaataacttattattttaatgcttaatcaggtcaccaaaataagtaaatgggttgccatggaataagccttttgtgacttaagatatttgtttctggatttcagttgcttcatccttaacacgttatgttgaatctctgagaggttttttctggacctaatgttctttaaccctatgattgcatatataatttaaaaaattaagtgtgt

SEQ ID NO: 33715 - DNA, 267 bp, Homo sapiens
  misc_feature 15: s=g or c
  misc_feature 16: r=a or g
  misc_feature 172: d=a or g or t
aatcacttctttcasrgcagttgtattgtgccgtggctagaactgcatgacacatgtcctgtatgtaggaagagcttaaatggtgaggactctactcggcaaagccagagcactgaggcctctgcaagcaacagatttagcaatgacaagtcagctacatgaccgatggacdttctgaagctaaagaccacacctgaatcagggctgtggtaatcatcttaccatagctgtaaattgtatcaaaacaaaaaattagtagatggacat

SEQ ID NO: 33716 - DNA, 149 bp, Homo sapiens
tgactcattgttttttttcctcctagcttgtttatgaatttttcttaagatttttagagtctccagatttccaacctaatatagcgaagaaatatattgatcagaagtttgtattgcagcttttagagctctttgacagtgaagatccg

SEQ ID NO: 33717 - DNA, 424 bp, Homo sapiens
ttttaactccttctctgcattagggatctggaaagccaggcaggatcaaccataggcttcatttggtctctgttacactggtcttccaaggcagacccttagctctgtgcactggttctcagaagtgtgggttcctgggaccagcatcattggtgttacctgggagcctgttagatctacagaatctcaggcctcaccctagacctataggatcagcatattctggaaggagggccctgcaatctgtgttttaccaaaccctgcagatgattctgatacatgctcaagtctgagagccatagtgcatagtgatctagtgcgttaagctcatggacttccaccagaataaaatcaggacttacctcagtgtaaagctctcagggccaagcctgtgtcatcaccagcaccctatgattgtctgtgc

SEQ ID NO: 33718 - DNA, 142 bp, Homo sapiens
ttcggactgcttcccttcaccaatgtgaacaactttttttcccaaacagtgttaaaagccactttgcaacacttgacttcatcttaatgtacattcactgttgttacatacatatctaagtaaatcaaagttttgggtgtgt

SEQ ID NO: 33719 - DNA, 287 bp, Homo sapiens
tattagttgtggactcgggcaagagctcattagctcagcaaggataaataaggcactgtccctgtgatgggctccacagcggtgtttctcaaagtgtggtgtggagacccatttgcagtagtatcagggcagtgcttgttaatagcagacttaggactcagaaatctcagacctatacgtgggtaaaggtactaaattgggaaattcagtatggcctaagtatagaataggtgggagatgatgtcatagaaacatgaagccagaaaaatagttaagaaccttgcaca

SEQ ID NO: 33720 - DNA, 53 bp, Homo sapiens
tcccaccggcggtgtgtgagtgattcaggaccttcccagcctgggcagcattt

SEQ ID NO: 33721 - DNA, 131 bp, Homo sapiens
  misc_feature 113: m=a or c
ctgggactacaggcgtacaccaccacgcccagctaatttttgtatttttagtagagacggggtttcgccatgttggccaggctggtctcgaactcctgacctcaggtgattcmacccgccttggcctccaa

SEQ ID NO: 33722 - DNA, 420 bp, Homo sapiens
  misc_feature 115: m=a or c
  misc_feature 120: h=a or c or t
  misc_feature 313: h=a or c or t
  misc_feature 315: b=c or g or t
  misc_feature 382: n=a, g, c or t
ccaaaatttctagtgatttattttatagtgattctgtaatgagaagtctcgtcctactaaatatcaaaaggttttaaagcaagaatgtctaaaacagtgatgatgatgtaagaamtagghgtgttacccagataccagaagagacttctctgtctgttggagatttaagtatacattttctggccaggcccagtggctcacgcttgtaatcccagcactttgggaggccaaggaggtcagatcacttgagatcaggagttcaagaccagcctggccaacatggtaaaaccccatctctactaaaaatagagahabtagctgggtgtggtggtgcacgcctgtagtctcagctactcgggaggctaaggcagaagagtcactngaccccaggtggcaggggttgcagtgagatgagattgt

SEQ ID NO: 33723 - DNA, 234 bp, Homo sapiens
  misc_feature 125: m=a or c
  misc_feature 131: h=a or c or t
  misc_feature 132: r=a or g
  misc_feature 139: m=a or c
  misc_feature 158: m=a or c
gtgtttttcaggaagacttggccaggccgtgttccgtgtctctggattcaagtcccaggagtcctgaccagagagcaggcatcagtgtttttctgaccgaagttctcattttccctgacaatggmaatgghrcaagaamaaatgaccatgaataaggmattgagtccagacgcggctgcttactgctgctcggcctgccacggcgatgagacctggagttacaaccaccccatt

SEQ ID NO: 33724 - DNA, 136 bp, Homo sapiens
tccacagagatggggactgccctgggcaccagcttgtgatgggggccgcggtccacagcgatgggtggtgccggctggtgacacggcatagaggggcagcgaccaacaaggtgtggcctaatgcttgaggcccgac

SEQ ID NO: 33725 - DNA, 243 bp, Homo sapiens
  misc_feature 15: k=g or t
  misc_feature 101: r=a or g
  misc_feature 102: w=a or t
  misc_feature 112: k=g or t
  misc_feature 114: m=a or c
  misc_feature 115: w=a or t
  misc_feature 123: m=a or c
  misc_feature 136: w=a or t
  misc_feature 177: m=a or c
  misc_feature 181: h=a or c or t
  misc_feature 186: w=a or t
caaccattgtggaaktcagtgtggcgattcctcaggtatctagaactagaaataccatttgacccagccatcccattactgggtatatacccaaatgactrwaaatcatgckgmwataaaagmcacatgcacacgwatgtttattgcggcattattcacgatagcaaagacttggamccahcccawatgtccaacaatgatagactggattaagaaaatgtggcacatatacaccatggaata

SEQ ID NO: 33726 - DNA, 378 bp, Homo sapiens
  misc_feature 112: d=a or g or t
  misc_feature 116: r=a or g
  misc_feature 118: k=g or t
  misc_feature 121: k=g or t
  misc_feature 123: m=a or c
  misc_feature 126: r=a or g
  misc_feature 278: y=c or t
  misc_feature 307: w=a or t
  misc_feature 309: n=a, g, c or t
aaattgtctccattgtttatatttggggaaatctgccaaaatttgaggaaagtataaacgtcagtttttttttttctcacaatgcccaatacatcagccattctctccacgdaaarckgckgmatrcaagtggagtattactgaagagtacaccattggtcttagctatttttttctcttcctgcagtcctcttctgcccatgttttcctatacacagcaactataaggtgctgaagacatttggttttctcttaagctgaaggagttctcagctgtyctgtctttggggcatgggcatcagggagwtnctgacagtagaaaggtattatgtagtgtgatttttttgttgctttctggggtgaactgtatacttaaca

SEQ ID NO: 33727 - DNA, 166 bp, Homo sapiens
agggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcgg

SEQ ID NO: 33728 - DNA, 393 bp, Homo sapiens
  misc_feature 117: m=a or c
atactgccggaactgtggctaatggtgcggaccaccctgctcactgttagcaaagtgggtagctaccctctcttctggaagcccctctgcagcactcctcttgggagtagaaaaggmagtggtcaagatctgcctgcagctcagccccagcctcctcagctttctgcagctgagcctccagacctacatttgggagctgatccgtcttgctctcagttagggcccagcccttctgtggggaccaggaaaatctttgctcacctggagaagctgctggttcagcccaactttatctaacgccaaagcctcatttaaggcactgagcttgacagctgcagcccgaagatcagctacttctgtcttcagggtgttttcagaactcgacagctctgc

SEQ ID NO: 33729 - DNA, 277 bp, Homo sapiens
  misc_feature 108: m=a or c
  misc_feature 163: b=c or g or t
attgtgacttccctgatgaagttgaagaactctttcatcaatctaccaacagcccttaccaacgagcttgactggccccaactctctggtgctacaggatttctggamtccactgttggaattaaagaaaaatctatttaccttcgcttatggaaaagaaacbactgtaatcacagggactaccagaatatttcaagaaatggtgcatcttcccgaaacctgaagaaatttatagaaaagcttgtctagaaacaaggtgttggactatcccgcccat

SEQ ID NO: 33730 - DNA, 408 bp, Homo sapiens
cttttatgtatcttactgtaagaggtgtggagtttggcctactaattgaacccccagttcttggataaagtccaccgacagttactgggcaagaaatttttcagtgatcagtggaatcaattttcccaaatcttggtcttaggcagtgtcgtgggagtcttccttagaattgccttgtgattgtccaaactatcccaagaataaatgtgttccaaatggatttgaaaacaggcctgtatttctgtgactgtcactgcctttcacaaacacttgactacatcaaatgtctaaaactgaaaatcaaatttttgtgatataactattataaaagtatgtttacatcaacatactgtccacatttgccaccttgcatgggggtttttaatttgtgtgtgtgtgtgagagaca

SEQ ID NO: 33731 - DNA, 231 bp, Homo sapiens
  misc_feature 144: m=a or c
tctctactaaaaatacaaaaattaggccggcatggtggctcacgcctgtaatcccagcactttgggaggccgaggtggactgagttcaggagttcgagaccagcctggccaacatggtgaaaccctgcctcaaccaaaaataamataaggtagccaggcatggtggcacgcacctataatcccagctacttgggaggctgaggcaggagagtcgcttaaacctgggtggca

SEQ ID NO: 33732 - DNA, 86 bp, Homo sapiens
  misc_feature 15: d=a or g or t
  misc_feature 72: k=g or t
aaaaaaatggcggcdttcagtatgcacccctgctaaaggctctcccggcaccggggccacctcgcgcaggckgcttttgcttctgc

SEQ ID NO: 33733 - DNA, 409 bp, Homo sapiens
  misc_feature 326: n=a, g, c or t
tgtcttatatgtattatgtactgttttcttacaataaagtaagccagagaaaagaaaatgttattaaggaaatcataaggaagagaaaatctacttactttcattaagtggaagtggatcatcataaaggcctacatccttgtcatcttcacattgaggaggaggagttaagggggagattgatctactgtcttaggggtggcagaggcagaagaaaattcacatataggtagacctgtgtggttcaaactgtcattaagggtcacctgtatatattttctttttcctttttatttttagtagagacaggcttttgccacgttgcncaagctggtctcaaactcctgagctcaagtgatctgcccacctcggcctcccaaaagtgctgggattgcaggtgtgagccgct

SEQ ID NO: 33734 - DNA, 148 bp, Homo sapiens
  misc_feature 97: k=g or t
atgattgtctttaggtaagtgagattgtcaggcttttgctttgttttattttgtttttatttgaatattcgttttctacagtgagcatgtattttgkaacaatgaaacatatgcagattacttgtaaataaaattatatctgggagaa

SEQ ID NO: 33735 - DNA, 298 bp, Homo sapiens
  misc_feature 288: b=c or g or t
  misc_feature 289: w=a or t
  misc_feature 291: m=a or c
  misc_feature 292: m=a or c
tataaaaactaaagtttgctggaggtattctctctcctttccattctgtctcttaagccagcccaaagacatagtttctatagggttcttgtgtctgtagaaataggtatatgatttaacagctaaggagctagcaaatattaattctgtaagaccctgtgcctatttatgaagaaataatctttgacatgctaaattcccttttatattctaaaaaaaaaaaatttaatgaaacccttctttacaagggcctgatgtgaaattaagagtatgaatacctactagtabwammccaccc

SEQ ID NO: 33736 - DNA, 188 bp, Homo sapiens
aattcgcaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggc

SEQ ID NO: 33737 - DNA, 196 bp, Homo sapiens
tgtgttataataccagggaccctcacatggctgtgttagattctaaccaatagacaataataagtcaaagcaaagaccgttactgattccttccattgtttctttagagactttggtttagcgctctgaactttctgattatcagatcttatgtgtttgctaatatataaaataacaaattagacataatgcccga

SEQ ID NO: 33738 - DNA, 190 bp, Homo sapiens
  misc_feature 2: b=c or g or t
  misc_feature 84: r=a or g
  misc_feature 99: r=a or g
  misc_feature 114: r=a or g
  misc_feature 117: v=a or c or g
  misc_feature 125: v=a or c or g
  misc_feature 129: m=a or c
  misc_feature 174: m=a or c
gbagataaaatgctatgggagttcatagaatggagaccgtgctgcttgtttggatttggcttctttcttcataaggctttatgragtcctttatgctartccttgagagatggrtavgccttgavtagmagatggagggcaagatgatattctcactaggccagtatgtgggamtataaaggcatggatg

SEQ ID NO: 33739 - DNA, 299 bp, Homo sapiens
  misc_feature 99: k=g or t
  misc_feature 222: v=a or c or g
  misc_feature 238: k=g or t
ttgcctgtttattttgtcttctttcttcattcacttatctagagagatcttgaaaaaagaaatgcagaaactctagccatattctaattgaaatatttktatacctctttcagtcaatggcactaaagggctttctgtcaatgatttctactccggtttggagagctcgggatggcttcgccatatcaaagctgttatggatgctgcaatcttcttggccavagtaatactttatctktcatacttggtcttggggtctataatgattgggaaggagtagatgtattctgttggggtgc

SEQ ID NO: 33740 - DNA, 208 bp, Homo sapiens
  misc_feature 91: k=g or t
taagtattctttataactcttttctctctttaaaatgctaataacttcttcgttattacaaagtcaatacattttcaattactgtaatttkttaagatcttctgaattgcacctgccaacaatttttaaaggaatgtgaagaaacgttagacaagaaaagtccattagagaacatttctatagatgttcatgttcagataactgcccc

SEQ ID NO: 33741 - DNA, 88 bp, Homo sapiens
  misc_feature 71: m=a or c
  misc_feature 72: m=a or c
atcatgaatgctgttttgtttctgactcaaattgtcctctctcacaaataattgaaaccttttttgccttmmttcccttgtcttaaca

SEQ ID NO: 33742 - DNA, 287 bp, Homo sapiens
  misc_feature 94: h=a or c or t
  misc_feature 95: n=a, g, c or t
  misc_feature 96: n=a, g, c or t
tactatgttttgtaaatccattttgtagagggcatgtaaataaatgttttcctgtagtcatagattattcaggactgtcctttagttctgtcthnngaactcatgggaataattgtgagtcagcgtaacatttcaagagtctaaaggtggccgggtgtggtggctttaatcccagcactttgggaagccgaggtgggcggatcgcctgaggtcaggagttcgagaccagcctgaccggcgtggagagaccccatctctactgaaaatacaaaaaattgaccggacgc

SEQ ID NO: 33743 - DNA, 234 bp, Homo sapiens
  misc_feature 80: r=a or g
  misc_feature 91: s=g or c
  misc_feature 208: s=g or c
tagtcccagctacttagaaggctagggtgggcagactgcttgagctcaggagttcaagaccagcctggacaatatgatgraaccccatctscaaccaaaaaattagctgggcgtggtggcaggtgtctgtagtcccagctacttgggaggctgtggtgggaggatcgcttgagcacgggaggcggaggttgcagagagccgagattgsaccactgcattccaggccgggcaaga

SEQ ID NO: 33744 - DNA, 70 bp, Homo sapiens
gactaagatatatgcaagggtcaccagtttagagatcagtcaaattggaaaaagtgccaagactggatgt

SEQ ID NO: 33745 - DNA, 73 bp, Homo sapiens
  misc_feature 43: w=a or t
caagagctctctttttttgcacataaacactaaaggtatatgwagtctgactttcaattcagcagagtaacta

SEQ ID NO: 33746 - DNA, 169 bp, Homo sapiens
  misc_feature 91: r=a or g
catttcggagatcatacaacagaggaatatgttgagtatacacagtgttgaaaagcctgtgacacaaacagtcatattaccaagcacaagrcagtaatagtttggtatgctataaaagccttgaatattctctccatttttaagaagtgagattcatactagaaaaacc

SEQ ID NO: 33747 - DNA, 83 bp, Homo sapiens
ccatcggcactaacgccccgctccaccctcagcagatgataatatcaagacacctgccgagcgtctgcgggggccgcttccac

SEQ ID NO: 33748 - DNA, 144 bp, Homo sapiens
  misc_feature 119: w=a or t
aaccactcccggctaacttttgtatttttagtacagacgaggtttcaccgtgttagccaggatggtcttgatctcctgatctcgtgatctgcctgcttcaggctcccaaagtgctgcawtacaggcgtgagccaccgtgccctc

SEQ ID NO: 33749 - DNA, 350 bp, Homo sapiens
  misc_feature 309: b=c or g or t
  misc_feature 318: k=g or t
  misc_feature 323: k=g or t
  misc_feature 333: k=g or t
tattaattttgaagacataatatgttaaagctgtgtgaggaaaggcaaaagaatggcttggaattgtggagtgtctatcttaaaatattagggtttttggtattcttaactttaaccacaagaggtctccaaaggatttgatattttgtgaattactgtttaatggttactaaaatctttacatttctttttatatctgaaagtacaggtttatttactttgtatcatattgtgacttagaacaaatattagagatgatagtaatctaaaattattactcctaaataatggtacactatcaatttttcbtagattatktattkttatttatgkaaagtatgtttgtaaga

SEQ ID NO: 33750 - DNA, 299 bp, Homo sapiens
ctatgacaaaataccataaaaaaaaattaaatcatgaagcacaatttacattagctagatttcaataaagtttttgatttagaagtatggagatgaaacttaaagtcttctgtaatgctgatatttttttcagtaggggtggtgatgttggtgccatagtgagtagggggagtttgaagccacaagtaaaataaaaattctttttttttactgtcactaattttaattttcaaattattcaagaattgactggaaagagcttctttggtctagctcctgattctttttgacatgacctc

SEQ ID NO: 33751 - DNA, 245 bp, Homo sapiens
  misc_feature 196: k=g or t
gtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctkttcttgtttccctctggaagtccttagtggctgcatccttggtgcgacg

SEQ ID NO: 33752 - DNA, 119 bp, Homo sapiens
  misc_feature 84: y=c or t
  misc_feature 97: k=g or t
atacttttttcaaggtcaaccaatagaacatactttattcaacagtttgttagtttgctttttaaatatttagccacatggtaygtaggctttccakgtacactcttgccctggcccct

SEQ ID NO: 33753 - DNA, 55 bp, Homo sapiens
  misc_feature 9: y=c or t
tctgttttyataaatgaaagatcattaatctgcatatgaaaattccacaacgcaa

SEQ ID NO: 33754 - DNA, 180 bp, Homo sapiens
  misc_feature 95: k=g or t
cattatgcatctatagtattgtattttttattctagtctaagcttaatattactaaattgggaggtcctaacataagatctagatatctttgtckatgccttagtactaagaacagagtataataggctgggcacagtggctcacgcctgtaataccagcactttgggaggccgaggtgg

SEQ ID NO: 33755 - DNA, 256 bp, Homo sapiens
  misc_feature 80: v=a or c or g
  misc_feature 82: k=g or t
  misc_feature 85: k=g or t
  misc_feature 126: y=c or t
  misc_feature 212: k=g or t
cttctgttttgtgtttccttgtacggatttggtagaatatttattaaaggctgtttcttttttttaattaatagcttgcvtkttkttccacagagggtttgaggcaactttaccacacaaatacayaaaatgaaatagcatataaacagaaaatcagaactgagaaaaaaggttgcacatgtgttgattttaattcagatttgcttcatgtktttattgatgcctagtgcaaaatgacaaatagcatcaattatgt

SEQ ID NO: 33756 - DNA, 430 bp, Homo sapiens
  misc_feature 338: k=g or t
  misc_feature 357: k=g or t
  misc_feature 362: d=a or g or t
  misc_feature 363: y=c or t
  misc_feature 377: k=g or t
caaagagagatagtcttactaatgtgagtatcagcctgcgtgtggcattttcagcacctgccctgtatccccttacattttggatgttacaggcagaaagcattctgcatattcacgtgtgtttatataatctctgtatagctcactttccttatctgtaagcaagttaatagttgtcagatattatgtaatctgaaaatgaactttacttgtataaacacttttaaatattcttaaaaggtttttacatctttacctttctttcagattcctagcattttccccacatatgtgcaatgtgactatgtattgatcattcttgaattaaatcattctgkttgaattaggatcattctktcctdytgtttgaattagakcatatcttgtgaattttgcaagttcaatagaagaacaaatctgagtctacaga

SEQ ID NO: 33757 - DNA, 317 bp, Homo sapiens
  misc_feature 2: w=a or t
  misc_feature 16: r=a or g
  misc_feature 33: n=a, g, c or t
  misc_feature 34: n=a, g, c or t
  misc_feature 86: k=g or t
  misc_feature 89: k=g or t
  misc_feature 92: k=g or t
  misc_feature 102: k=g or t
  misc_feature 198: n=a, g, c or t
  misc_feature 226: m=a or c
cwagaatacacaccaraacaatatgtcagcttnnctttggcctgcagtttgtaccaaatccttaatttttcctgaatgagcaagcktckctkaaaagatgckctctagtcatttggtctcatggcagtaagcctcatgtatactaaggagagtcttccaggtgtgacaatcaggatatagaaaaacaaacgtagtgtntgggatctgtttggagactgggatgggmacaagttcatttacttaggggtcagagagtctcgaccagaggaggccattcccagtcctaatcagcaccttccagagacaaggctgcaggc

SEQ ID NO: 33758 - DNA, 232 bp, Homo sapiens
  misc_feature 204: h=a or c or t
  misc_feature 231: k=g or t
tagtcccagctacttagaaggctagggtgggcagactgcttgagctcaggagttcaagaccagcctggacaatatgatgaaaccccatctccacaaaaaattagctgggcgtggtggcaggtgtctgtagtcccagctacttgggaggctgtggtgggaggatcgcttgagcacgggaggcggaggttgcagagagccgagathgcaccactgcattccaggccgggcaaka

SEQ ID NO: 33759 - DNA, 225 bp, Homo sapiens
  misc_feature 90: w=a or t
ctcttcttgtctcccgcggcgccagcgccttcccttggcccgggcgggggcctcggctccctgcagagctctccgtagtcagtgggggawatttcgttctagcggacaaccagcccctgagctgggcgagaggtgccaagggagcttctgtcccgaggaccaggggatgcgaaggggcaaagagattgaaagaggggagtcacataatcagcatacgtttatgaa

SEQ ID NO: 33760 - DNA, 355 bp, Homo sapiens
  misc_feature 220: d=a or g or t
  misc_feature 221: r=a or g
  misc_feature 298: d=a or g or t
  misc_feature 321: k=g or t
  misc_feature 322: s=g or c
tttaaatttactattaatgctatgatggttctctttgccacctagccatacaatgataaattgtctccagcttttctcttctttgttgctgcaatatcatttgcataatgcctccttccttctccttgctgtgtctggaactcttcccactgctatcatctagttttgcctcttttcaactcttgtcataatttctttcccagcggctccacttcttcadrtctctctacaccccctctctatgcttttcccgatttgcaaaacacagatctcatcaggcaacaccttaaaatccttdgtttctcatatccagtcattaakscactcatgcatttcatgcacgcttatgtgtcct

SEQ ID NO: 33761 - DNA, 392 bp, Homo sapiens
  misc_feature 198: w=a or t
  misc_feature 339: r=a or g
  misc_feature 349: n=a, g, c or t
  misc_feature 351: n=a, g, c or t
  misc_feature 356: r=a or g
ggttagccgtgatgccatacaggtgagcctcattgtatgcaacagaaagcgtggctcctaacagaaagcacggctcctcaaaaagccgaacgaaaacagttgctttagagaggagttcgaggggcttgtttgaattttatgctttcgggcagccttttctaaaatgtgtcctaaagaataccagtctgtgaatatgcwgtggaaaatgctgggtactctgtggccgtacagaagacttagtctgtatattagcatatattagtaccttaaagagaagtaatgcagtattttccaagctaatttggctaatgtccaagaacctagtgttctgagcagggraattctgaananggggraattctacactatgggcactttctcttttttttttt

SEQ ID NO: 33762 - DNA, 58 bp, Homo sapiens
cacagtgtttttggttttgtttttctgaaatcttggtttgatcaaatctttttttttt

SEQ ID NO: 33763 - DNA, 361 bp, Homo sapiens
ttgtggcttgagtgaagttgaaaggcttaagaatctcttgctgcttctactcttcagtttttcccattgtgattcaattaaatccaaaaaatcatagatgatagcaactgacacttactgattttgcataatatgccaggccctattctaggcaccttgaatatattgtcccttttaattctgttaatggctctgaaaatattttattatgttccttttaccaataatcatttttagtcagcaaaactatctatgatttaagagctctgtagatgttgggctaagactcatgagtgcttgtgctaagttgcttttctccataacttgggcctcggaatgattagataaacgttttttcctt

SEQ ID NO: 33764 - DNA, 406 bp, Homo sapiens
  misc_feature 347: y=c or t
gattactggtgcaagccatcatgcccagctaattttaaaaaattatttgttagaaatgggctctcactacgttgctcaagctggccttgaaactactgaccgcaaacaatcctcccaccttggctgcccaaagtgctgagattacaggcatgagccaccatgttgggctgagtcttaacacattttcgttacatttatttccaggtatttcatctctttgcagtcttaatgaggtattttcttatgtgtattatctatcctaattgatagttttttctataaagaaagctacagttgcatattaattttgctaccagccatcttacaggattttctttatgtttttyttattatttcagttgattcttttgagctttccaggtaagtaatcacaaatctgcaaata

SEQ ID NO: 33765 - DNA, 207 bp, Homo sapiens
cgcatttttttaattattacttttcttctctttgaagtcaatcctctcaacacagcttgagaattgcaatgaatttggggatctgagaaacaatcttttctaaatatttgtatgttatttggaaacaattacagtggcaaaagagaacaagaggctaccttttagtatcaatctatctgtacacttaaaaaaaaaaaaaaaaaaaaa

SEQ ID NO: 33766 - DNA, 269 bp, Homo sapiens
  misc_feature 76: r=a or g
  misc_feature 106: r=a or g
tatacaggcaatcttatccaatcttcactatagtccgatgaggtaggttcaatcattaaactgatttttaagttgrggaaagtgtggttttaaagaggttgagtarcttgttagtatctacagtggatattgggattgaagccctggcaggcaaccttgattcttgactgacaatggcaccatactggatttgatggtacctgtggttaacttcttggggacccaaatcttacatggacttttgaatctaaatgatgtaatctcaccac

SEQ ID NO: 33767 - DNA, 94 bp, Homo sapiens
  misc_feature 19: y=c or t
  misc_feature 20: k=g or t
  misc_feature 22: k=g or t
  misc_feature 25: k=g or t
  misc_feature 33: r=a or g
  misc_feature 34: k=g or t
  misc_feature 68: r=a or g
ctttcatattgacattgtyktkctktcaaatgrktaactttattgatcatcctcttgttcttctagcraaagacggtgctttatgcactcagct

SEQ ID NO: 33768 - DNA, 259 bp, Homo sapiens
aacacctggcctgttaagcaaacttttcttcttttagggtctacatgcatttatatttaatgagtaaaataaagttaatgcatggcaaaaatatttttctgaggaatttgaaatcttaccgaaatggagaatcttttttccttttttctttaaaaacacccatgcttggcttcttggaatgggaggctccgaaatcatagtcctccaactcttcccagctatctccagacttgaagatagtctgaccccaacgcctccc

SEQ ID NO: 33769 - DNA, 150 bp, Homo sapiens
acacataaatgttcccgctgtgtccctggatatggaataagcaggtataaaaaatattttaattatagttttgttataaatataacttatgagaaaaaaatttgataggaataatactgtatattactaatttttaactatccctagggc

SEQ ID NO: 33770 - DNA, 189 bp, Homo sapiens
tttgtttttacattgtaatgtttttaagagtttaaatatattattttcattttaataataatttctattcatagttttttttgtagaatgtgagactgcatgaataaatgtagtctctttgaacccataaatttagtacaaaacctactaacattataccatgaatatattttctttgtaaacctggct

SEQ ID NO: 33771 - DNA, 180 bp, Homo sapiens
  misc_feature 93: k=g or t
  misc_feature 108: k=g or t
cattatgcatctatagtattgtattttttattctagtctaagcttaatattactaaattgggaggtcctaacataagatctagatatctttgkctatgccttagtackaagaacagagtataataggctgggcacagtggctcacgcctgtaataccagcactttgggaggccgaggtgg

SEQ ID NO: 33772 - DNA, 266 bp, Homo sapiens
  misc_feature 132: s=g or c
gtactgagacgcctgggatctcaaaatggcggccccgtgcggaaacagcgtctgggagcagtcatgttgcctcctgaacaaagccgctgaagatgaagaatgggcaaaatcgccccatacggaacagcgcasctcgggagcccgttacctggctcgcgaacacgaagcgggagagttcgccaatatggatgtgacagcggttcccattaagcgaccctgggatggcacaaatgaaacaatctctctatcatgatattcccccaaat

SEQ ID NO: 33773 - DNA, 445 bp, Homo sapiens
  misc_feature 128: n=a, g, c or t
  misc_feature 133: s=g or c
  misc_feature 135: k=g or t
  misc_feature 136: y=c or t
  misc_feature 159: n=a, g, c or t
  misc_feature 183: m=a or c
  misc_feature 184: s=g or c
  misc_feature 185: k=g or t
  misc_feature 186: b=c or g or t
  misc_feature 199: n=a, g, c or t
  misc_feature 200: k=g or t
  misc_feature 202: r=a or g
  misc_feature 309: k=g or t
  misc_feature 359: n=a, g, c or t
  misc_feature 360: n=a, g, c or t
  misc_feature 361: s=g or c
  misc_feature 363: n=a, g, c or t
  misc_feature 375: r=a or g
  misc_feature 401: r=a or g
tagtaaataaactactatttaccctagtaaatactcctaggtatttacctaggagtgcaattgcaggatggtggggtaagactatttttagctttgtaagaaactgcccaccgtctggcaggtgtacnccaasakytcattgagaacgggccatgatcncgatggcggttttgtggaatagamskbgggggaaggtgcnkaraggatagagaaatcagattgttgctgtgtctgtgtagaaagaagtagacatgggagacttcattttgttctgtactaagaaaaattcttctgccttgggatgctgtkgatctttgaccttacccccaaccatgtgctttctgaaacatgtgctgtannsangggtacttgagrttagggagtggtgatgactcttaatragcatgctgccttcaagcatctgtttaacaaagcacatcttgca

SEQ ID NO: 33774 - DNA, 195 bp, Homo sapiens
acgcaaataattctaatgattcattggggtttaaccatgtttgtgcatagtctgcagaacattataatactaaagactgagagggttgaagtttaaccttattttgggtttgtgtaaattgtgaaaaaatattaactagatgcagcatgggttaaatgctcacatcttcatgaagggatctttttccaggaagta

SEQ ID NO: 33775 - DNA, 129 bp, Homo sapiens
ccataactgtgggtttatttatttctgggttatttattctgttccgttggtctgtctgtctttttttatgacagtacaatgctgttttgattaaaatagatttaaaatatattttaaaatcagggaatc

SEQ ID NO: 33776 - DNA, 417 bp, Homo sapiens
  misc_feature 130: k=g or t
  misc_feature 131: y=c or t
  misc_feature 294: b=c or g or t
  misc_feature 295: n=a, g, c or t
  misc_feature 296: r=a or g
  misc_feature 355: k=g or t
  misc_feature 356: y=c or t
  misc_feature 392: d=a or g or t
gactagagattacagtcatttttgatcaggctgatgtcataggaacagtaccaaggggacttctgaatcaagcaccctagaaagagctacttagaactacttgcattttctttgtggcatctcttatagkyatgaaaaaatttcaaacatttttcatggataaaaggatttaatcagaaaagcatttggatatacatatttgaaatcatagcttgcctgtatgttactagagtagttggagagtggaaaagtatctatattctaaagactgtttcatcatttgggtgaaaaacbnraaaaagagagtaattttgtttaatagctctttcacaaataaaaaaaagaatgttcatckytagagactatcgagatctcatcaggtttacaacaadctttagattagcaagctcaatttca

SEQ ID NO: 33777 - DNA, 190 bp, Homo sapiens
  misc_feature 115: n=a, g, c or t
cggcgtgcagtggcatgttcttggctcactgtagcctctgcctccgcctcccaggttcaaaggattcccctgccttagccaccggagaagccggtgtgggattacaggtgtgtgncactatgcttggtaaatttctgtatttttagtagagacagggtttcgccatggtggccaggctggtcttaaactc

SEQ ID NO: 33778 - DNA, 225 bp, Homo sapiens
caacctctccctcctgggttcaagtgattctcctgcctcagcttctcgagtagctgggactacaggcaagcatcaccacactcagctaatttttgttattttagtagagatggggtttcgccatgttggccaggctggtcttgaactcctgacctcaggtgatctgcccgccttggcctcccaaagtgccgggattacaggcctgagccactatgcccaaccctc

SEQ ID NO: 33779 - DNA, 74 bp, Homo sapiens
agatcctctcacctcagcctccccagtagctgggaatacaggcatgtgctacaaaggctaattttttttttttt

SEQ ID NO: 33780 - DNA, 159 bp, Homo sapiens
  misc_feature 111: b=c or g or t
  misc_feature 114: k=g or t
  misc_feature 118: b=c or g or t
  misc_feature 121: r=a or g
tgaaatattaaatattctccaattaaaagtggtatttagttggtcttttaattttgagtctcttttacaaagtccagggaagtttagatcaccacaaggctcagttactcbagktttbcgraggatagctgatgggcaggtaattttgaaggaggggtg

SEQ ID NO: 33781 - DNA, 205 bp, Homo sapiens
  misc_feature 97: r=a or g
  misc_feature 124: v=a or c or g
  misc_feature 178: h=a or c or t
cccggaggagtttttggtggggtttctgcactgaggtggaaacccagcagaacctgcccttcttccctcccctgctccgcaaggcagcccaccccgrccttgagatcccaggtttggagaatcvtgctgagagcgaacagtaggaggattccccaaagcttccagcttgccacctgghagaaggtcactttcttttgagcaaagg

SEQ ID NO: 33782 - DNA, 142 bp, Homo sapiens
  misc_feature 100: k=g or t
  misc_feature 111: m=a or c
tatttagtgaataatgacaagaaaaaaaagtgtgtacctgtttagtacagacactactctgtactgatttttttttctgagtattttccatccagggttkgttgaaatccmcagatgtgtaactcacaaatatgaagggctc

SEQ ID NO: 33783 - DNA, 356 bp, Homo sapiens
  misc_feature 98: r=a or g
  misc_feature 103: r=a or g
  misc_feature 217: k=g or t
  misc_feature 291: r=a or g
aaatagtggggcaatcgctggtggaggtggcggagagcaaggtggcagccgggagcccatcagaggaaaagtccgaggcgctggaaccctgcgtccargcgtracggtcatcccgaaaggccggccccagtttcatccttttatcctgtaatctgtcaccatgaccctgacaaaaggttccttcacctactccagtggggaggaatatcgtggcgaktggaaggagggtgagaaggacccctggggagtatccatgatgaacacttcatttgctggaggacaaatacatcrggatatatagccaactttatggatcttcattttcaactccaggatttaattccatatagtgcctc

SEQ ID NO: 33784 - DNA, 232 bp, Homo sapiens
  misc_feature 95: s=g or c
agacggaatctcactctgtcacccaggctggagtacaatggcacaatcttggctcactgcaatttctgcctcccaggttcaagcaattctcctgsctcagccctcctgagtagctgggattacaggcatgtgccaccacacccagctaatttttgtatttttagtagagatggggtttcaccatattggccaggatggttctgaactcctgacctcaggtgatccgcgcgcc

SEQ ID NO: 33785 - DNA, 416 bp, Homo sapiens
  misc_feature 102: r=a or g
  misc_feature 103: r=a or g
cttatgactttactacatctattctcaaaatgcctaattgccaaatacaataacctttttttcagtccttatctgaatttttttcctctcttgtccttttarrgaactcctgactttcttcccaatttcatatattcaatgagacaggggtccccaaaccctgggctgcagaccagcaccagttcatggcctgttaagaaccgggctgcacagcaggagatgagtgactggcaagtgagcatcacagcctgagctccgcctcctgtcagattagcagacattagattctcataggattgcaaaccctatcatgaattatgcatgcaagggatttgggtttcgtcctccttatgagaatctaatgcctgatgatctgatggaacagtttcatcccaataccattcccagctcctgca

SEQ ID NO: 33786 - DNA, 186 bp, Homo sapiens
cactgagagtttcttatttttaatttgtgtatatagttattgatccccacttctctcaccaaggatatgagttctatcctctgggacaacctctaacatttaataggtaagggctcagtagatatttgaagaaagaatgaatgaatatcatttaacccataggagagttatttacagaaggctatc

SEQ ID NO: 33787 - DNA, 123 bp, Homo sapiens
atcactttatcgataatgtccttagacatataataaatttgtattttaaaagtgacttgatttggctgtgcaaggtggctcacgcttgtaatcccagcactttgggagactgaggcgggtggc

SEQ ID NO: 33788 - DNA, 406 bp, Homo sapiens
  misc_feature 97: y=c or t
  misc_feature 99: y=c or t
  misc_feature 210: k=g or t
tttgaaaaatagaaaaaaaatgaataaactaaaaatcccctgtaatttctccagagattttttttaaaaacacttaaattttatatatatgtatatytytgttgttgttatacttaataccttgaacagctttccaggttattaaataacattactttttgttgttgctgtttttgagacagggtctcatctatcgatagcccaggcttkcgtgcagtggtgtgatcatagctcgtgcagccttgacctcccaggcacaatccatcctcccgcctcagcctctccagtggctgggactacagggacacaccaccacgcccggctaatttttgtatttttttggtagagacaggattttgccatgttgcctggctagtctcaaacttctgggctcaagtgatcaccc

SEQ ID NO: 33789 - DNA, 310 bp, Homo sapiens
  misc_feature 27: v=a or c or g
tgtgttttatgatagcagttgctgggvtctacatagagaattttatttccttgaagccaattgacctgaatggaagttaggaccccaaatctcagacacttctgcatgtactggctcaggcagaatttgtaaaagatgtggctgttattgctgaaatatttgcatttaatttaatggtagcttacatatttgcacagtgttttgcagtttttctttacatgcttgtttaatcttttcaaaactctagtataaccaaagcagttatgaccactcctgagaaagtccacctcaactatgcatgtgccctggt

SEQ ID NO: 33790 - DNA, 238 bp, Homo sapiens
tgatttaattggtctggggtatgtattggcccttggggtatggggtagacttttcaaaaggtcctcaggttattcaaacgtcatgaaagtttgttcaaagcaattatacctgtggaaatgtagtcttgagatgctacttaagaatttatttcttaagtataatctataatacaaaaaacgaccattaaaaagaaaaaaaagttgaagaatcacctagcagcatgtgaggcgaccagcc

SEQ ID NO: 33791 - DNA, 210 bp, Homo sapiens
ttttgcagaggctggaaccggtttttcctttccatatttagtacttccttcaggatctcttataaggcaggcctagtggtgacaacatctctcagcatttgcttgtcttaaaggattttatttctccttcacttatgaagcttagtttggctggatatgaaattctgggttgaaaattcttttctttaagaatgttgaatattggccccc

SEQ ID NO: 33792 - DNA, 321 bp, Homo sapiens
  misc_feature 7: r=a or g
  misc_feature 97: k=g or t
  misc_feature 100: k=g or t
  misc_feature 104: k=g or t
  misc_feature 108: y=c or t
  misc_feature 112: y=c or t
  misc_feature 120: k=g or t
  misc_feature 127: y=c or t
  misc_feature 128: w=a or t
  misc_feature 140: k=g or t
  misc_feature 150: s=g or c
  misc_feature 151: k=g or t
  misc_feature 252: w=a or t
aataggrcacagctggtttctcatagctgctgcttgcattcagtttgttgtgatattgcatgtcatatattctggaaaactccacttacattctttkatktatktatytatytatttatktattttywtacttgtacttktttctcactskcttcttttttttatgatactttaagttctagggtacatgtgcacaacatgcatgtttgttacatatgtatacatgtgccatatattggcacatacattggwggctgcacccattaactcgttatttacattaggtatatctcctaatgctatccctctcccctcccccac

SEQ ID NO: 33793 - DNA, 385 bp, Homo sapiens
  misc_feature 24: n=a, g, c or t
  misc_feature 381: n=a, g, c or t
cacaggtaatacaagtgaaacgantagcataagaagaaaataaacatgagaatcttcaaactacaagcattgaacggtatcctccatccaagaagagaacccacttcatacaaggaaaaggcaaaaggaaaaggtcaagactgtgacctttataacactgtgaccccagctgtgggccaggtggagttgtctgtggtgacaccaagtacaggcctgacaccctggtttgacagaaggctcttcaagatccctggtctcacactgtagcagccaaaaggtaggtttacaatatacactgtccccaacttgccatggatcaattataatttttcaacttgactatggaggaaaaccatcgcaatttcagcttccagtcatggnccta

SEQ ID NO: 33794 - DNA, 373 bp, Homo sapiens
tatcttgtgaataaagatcattcttgtggactagtacgtggatgcattcataggctttgggaagcagtggtgtgcgtatgtgtgtctatatcaatattttatgtttataactctgcgtattaagtttatatagaaaaaaataatgtctttctttagtgtttgggggactcaatggtaatatgaccattgcagtgtaatctgactgctcactctagagaacacttctgttatacacaatgcacatacaaacataacccctaaagcgtagctaactgctcccactagataattgctgctaaaaacaaaacaaaacaaaacaatacaaaacaaaaaaaaccctaagtaatggaggaagaaatagcattcttttaaa

SEQ ID NO: 33795 - DNA, 141 bp, Homo sapiens
  misc_feature 99: s=g or c
tgtacaaatatttgttcaagtccccggtatatacccagagtggaattgctggatcatgttctaattttatgcctaatttttttgaggggacacccatastgttctgcacagctgctatgccatcttacattcccaccaagc

SEQ ID NO: 33796 - DNA, 389 bp, Homo sapiens
  misc_feature 303: w=a or t
  misc_feature 304: n=a, g, c or t
ttttgcccaggctggtctcaaactcctgtactcaagagatcctcccacctcaccctccccaaagtgctgtaattacaagcataagccatccatgcctggctcaattttttttgaatttttaatggcttgttctgtggcctaatatatggtctatccttgagaatgatccatatgctgaggaaaaaatgcattttctgcaactactggatgaaatgtctttaaacatcaattaggtacttttgttctatattatagattaagtccaatttttttggttgattttctgtctggatgatctgtccwntgctaaaagcggggtgaagtctccagctattattgtatggggatctctctctctccttagttctaataatatttgctgtatatat

SEQ ID NO: 33797 - DNA, 173 bp, Homo sapiens
  misc_feature 94: m=a or c
  misc_feature 95: m=a or c
ttcaaccttttaaatttttttgtgatacttcataaaattcataaaacatttggagctggaaataatttttaaaatcccattttctagataaagmmgtaaacccagagaggctaagtggcttgtctgtagttaaagagcaggtttgatgtattcgaaactcttctggtcattaa

SEQ ID NO: 33798 - DNA, 246 bp, Homo sapiens
agagctggaagaaagactgtcaacagctgagtgcgggcgccggcgccgtctacgcagtgcgttccaccgggtccgtatccctcccgattccgccccaccccgccctcggaactcgctgcctcaactcctgcggtgggactccggagcagcgtacaccgcccttgccttagtcctccccaaggccagggcagctgtgcggcctggcgcgggttacttggtgtggtgcaaaaagccagaaggagacac

SEQ ID NO: 33799 - DNA, 122 bp, Homo sapiens
  misc_feature 38: w=a or t
  misc_feature 44: y=c or t
  misc_feature 45: y=c or t
  misc_feature 74: w=a or t
  misc_feature 89: y=c or t
  misc_feature 93: k=g or t
  misc_feature 99: d=a or g or t
cactttaattgaccaacctgttacctactttgactttwtgcatyyaaaacagacactggcatggatatagtttwacttttaaactgtgyacakaactgdaaatgtgctatactgcatacttt

SEQ ID NO: 33800 - DNA, 249 bp, Homo sapiens
tgaccatttatatcacctcttttatttgacagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggccttc

SEQ ID NO: 33801 - DNA, 294 bp, Homo sapiens
aaacagatacattgatcaatggaacagaatataaagtccagaaataaaaccatgcatttacttacaccaacttatattcaacaaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgcaaa

SEQ ID NO: 33802 - DNA, 156 bp, Homo sapiens
  misc_feature 89: k=g or t
acttcccggttcaagcaattctcctgcctcagcctcctcagtagctgggattacaggcacgtgccaccatgcccagctaatttttgtakttttagttcatggccatgttggccaggctggtctcaaactcctgacctcaagtgatctgcccgccat

SEQ ID NO: 33803 - DNA, 300 bp, Homo sapiens
  misc_feature 84: s=g or c
  misc_feature 85: k=g or t
  misc_feature 103: k=g or t
gaggcctctgcctcccgggctcgggcgattctcgtgtctcggcctcccgggtggctgggattgcgggtgcacaccaccacaccskggctgatttatgtatttktttcgtggagacggggttttgccatgttggccgggctggtctcgagctcctgacctcgggtggtccacccgcctcggcctcccagggtgctgggattgcaggtgtgggccaccgtgcccggccttgactaccatattttaaatttactggaggacttttttgttctcttcttttttctttttttaatagcaccccac

SEQ ID NO: 33804 - DNA, 104 bp, Homo sapiens
  misc_feature 87: v=a or c or g
  misc_feature 93: r=a or g
tactggtttcttaggtgttgttctagagcctttattttctacagggcgtttgggctggggaagggtcctgtacatttgcaacaggavggtgtrgaatgagccct

SEQ ID NO: 33805 - DNA, 368 bp, Homo sapiens
  misc_feature 289: k=g or t
  misc_feature 290: n=a, g, c or t
agagagatggattgtcatcgtatgacttatcccaggtgagtttctggaaaaccctttccctgttggaattgtctccagcccaatggacttgggactcaattcagccctgagcttgagcccctcaacacaaaggattgccccatccccccactacaatggaaagagcagacctacaggtcccctgggggtctgctgctgtcactcctccctatagaactgagccatgaagaatgtgtgagtaccaggtgaagaaccaggggccatagtcaacctaagggctgagggacakntctgaggaccatgcgtgaactgtagtatgagtatactcagaggccagcaagagcagcttctgatccccctgggccccc

SEQ ID NO: 33806 - DNA, 147 bp, Homo sapiens
aataatacatacacagcatgttgacaaagagggtgtttgaattttcagtaatgctgttgctgggtggtggggttttacaggatttttaaaaacctttttggggaactttttctttgtggcagaatttgcataagggatcatgtcttt

SEQ ID NO: 33807 - DNA, 303 bp, Homo sapiens
  misc_feature 300: h=a or c or t
cgtaccctttaatttagcagtctctctgttttactcttttgtactcgtgtataagtaggcacataggaaattactacctaggtcatattgttatcaactgaataagataggaaaaagtgtggtcctacttctgcctcaacaccatcctcaccgttgacatttattgcgtttctctggactgacttcatagtttaaacgtcaagagaaggccgggctcagtggctcacgcctgtcatcccagcactttgggaggccgaggcgggcgggtcacgaggtcaagagatcgagaccatccgggchgaa

SEQ ID NO: 33808 - DNA, 313 bp, Homo sapiens
  misc_feature 103: s=g or c
  misc_feature 310: n=a, g, c or t
actgtgtatatatgcacactcacgcacatacatcttgcaaaacttcatttatctcttccaggaatttcctgaagccctactctaaaggaacccttggctaacstttttgtgacaatcaaaagactttctcttactatcttctgagaatattttccctcaaaaatattccttcttggcaatagatcattatcaatggccctttctcagttttgctgctattagcaatcaccgactgtggtaataacagaggcacaggcatcaaacttgcttccctgcagctgggagattggaatgcatttgctccccctcncca

SEQ ID NO: 33809 - DNA, 328 bp, Homo sapiens
  misc_feature 98: y=c or t
  misc_feature 103: w=a or t
aaacaaaaaaccccacgccagatgccatcatctggtgataacctttaggtgaataacgttctgggggcgctcatgaagctcagcttttctcattatcytttawagtagtgtccgagtatactactgtaatttaaccaacctgaccagttgataagcagttacagtattttatttacttaaaaaatgtgctgaaatgaccatccttataaatgcctttggattttttaaacttgttggtatgtaagatatatttctccccctgaaaatttttattcagatactaccttgtgaccaacacacctgttttgcagatgaaagactctgggcc

SEQ ID NO: 33810 - DNA, 56 bp, Homo sapiens
ctgcccaggagagattgtatagaaaccagggcgagtttttttgttttttttttttt

SEQ ID NO: 33811 - DNA, 378 bp, Homo sapiens
  misc_feature 102: y=c or t
  misc_feature 295: h=a or c or t
  misc_feature 297: n=a, g, c or t
  misc_feature 324: k=g or t
  misc_feature 349: w=a or t
gagtagaggaaatgagtctgatatgggattgtgaaattataactatgggtttaagaacaaaaggaagacaatattggtgactcagtccccaagcttaacttycccctttaatatagtaaatttgggtcccaagttgtttttgtttttgtttttgttttcgttttgagacggagtctcgctctgtcgcccaggctggagtgcagtggcgggatctcggctcactgcaagctccgcctcccgggttcacgccattctcctgcctcagcctcccgagtagctgggactacaggcgcchgncaccacacccggctaattttttgtatktttagtagaggcggggtttcactgwgttagccaggctggtctcgatctcctgac

SEQ ID NO: 33812 - DNA, 234 bp, Homo sapiens
tagtcccagctacttagaaggctagggtgggcagactgcttgagctcaggagttcaagaccagcctggacaatatgatgaaaccccatctccacaaaaaatttaggctgggcgtggtggcaggtgtctgtagtcccagctacttgggaggctgtggtgggaggatcgcttgagcacgggaggcggaggttgcagagagccgagattgcaccactgcattccaggccgggcaaga

SEQ ID NO: 33813 - DNA, 94 bp, Homo sapiens
tgaatcattcttaggctgaatataacctttaaaacattttttaaattaattaatatatcatttggttgcaatctctgaggatgagtatggcctt

SEQ ID NO: 33814 - DNA, 235 bp, Homo sapiens
ttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccct

SEQ ID NO: 33815 - DNA, 178 bp, Homo sapiens
  misc_feature 110: k=g or t
  misc_feature 123: k=g or t
  misc_feature 135: r=a or g
  misc_feature 136: r=a or g
tattgggaatgctctttgtgcttttgggcatctgaatggaagctttacatagaaccttaggtagaactcccccaaatcgccatatttaaaaattattttcactctattcktgcttaaaactgkactcttttgcarrttaacaattttatcactgattcagagttaaaaagaagactaa

SEQ ID NO: 33816 - DNA, 428 bp, Homo sapiens
  misc_feature 97: m=a or c
  misc_feature 365: r=a or g
  misc_feature 367: r=a or g
tcttagaattgtagaactacagccttgtaatgtcagacccctagaagtgtgtcatttttgagtgggcctcctgttccagccttcagtcagttggggmcccaagtctctgcagcatcccggagtacccacgtcgtaggtcttgggggcctttcctgacctcagtgctttgcagtgacagggacgtggatcttggagcagtgcagtcacaggttgagtctccctgatccaaaatccaaaatgctgccatgtgcggtgctcatgcctgtaatcccaacactttgggaggccgaggcgggtggatcacctgaggtcagaagttcaaaaccagcctggccaacatggtgaaaacctgtctctactaaaarcrcaaaaattagctggggatggtggcgggcactgtaatcccagctactcagggggctgagaca

SEQ ID NO: 33817 - DNA, 129 bp, Homo sapiens
gtttgcaatgttgaaattttttggtgaagtactgaacttgctttttttccggtttctacatgcagagatgaatttatactgccatcttacgactatttcttctttttaatacacttaactcaggccaca

SEQ ID NO: 33818 - DNA, 144 bp, Homo sapiens
cttctgcagctgctgctcctcatagtcgctgcgctcggggtccgagtcctcctgatacttgcgcttggccccggacacaggatggagtttcgctccagcctgggcaacagagcgagactccgtctcaaaaaaaaaaaaaaaaaa

SEQ ID NO: 33819 - DNA, 186 bp, Homo sapiens
ttatcaaggacactgtcttttcgccatcatgtgttcttggcccctctgttgaaattcaatctatcatagacaaatgggtttatttctgggctttctagcctgttctgttgcataccagtgccattctgcttttgttactgtagcttcacagtacactttgaaatcagagactttgatgcccgcagc

SEQ ID NO: 33820 - DNA, 111 bp, Homo sapiens
actagagcagtcaccacctctgggacaggtgaagatgtgtaacctatttgccgggggctatttgggagggaatagaggacggggagcgatgaggggacagtcgaggggtca

SEQ ID NO: 33821 - DNA, 405 bp, Homo sapiens
  misc_feature 243: b=c or g or t
  misc_feature 269: n=a, g, c or t
aggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagabttcctcttattttttatcctagaganaactgctaaaagggaatgatatatcagtactattcttctaaaacaactttttaaaaatgattatacaaagccaaatatgctcattatataaaatttagaagcaaaaagaaggaaataaaaattttccataattcta

SEQ ID NO: 33822 - DNA, 371 bp, Homo sapiens
ctttttccctccagcataggatccagcataggattaggtattgcctttagttgtcatgttcctttagtctcctttaatctggaacatgtctacagcctttatcttttatgactttgtcagttttaaagaatttaagccccccctcttgctttttaaaaatttgtctgatgtttccttatgattagaatcaggttatgccttgtcatccaggtgatgttttgtccttgagttatcacatctgcaggcacataatgtccatctcccactcatggtgatgtaaattttgatctccaggtcaaggcattgtctaatttttcctttgtgtaggtactgtttttcctttaaaagcactgagtaatcagtgggaacaa

SEQ ID NO: 33823 - DNA, 318 bp, Homo sapiens
aaagataataatatgtatgatgtaggatggtgggctaaaaaagacactaatgtaaagcacatagttcaatgagtatgctcaactagtggccactactgttatttttctgaaaccacatgacagagtgttgaccacctttctcatcagtttggccttgtcggttcaggttgagttttctactacctctgtccgggagttttagaggttcactaacatgcttcctgaccctgcttttatgttaaatggttgtcagtgtgagagaaataaaagtctcgggcaaaacgcagcaaaaggcatctccacactttcacacccccc

SEQ ID NO: 33824 - DNA, 151 bp, Homo sapiens
gttgtggtacactatcttatgtaacctgtctggtgagtttgtttggacaacctaactcagctttatttgacatggaacctaaaatagaagataagatcttgatattctgtacaagttgatgtaataccctgatgcgttttagaggactaga

SEQ ID NO: 33825 - DNA, 154 bp, Homo sapiens
agttctggtttgactcactctcatgttacggcaaaccttaagctgaatgaacaacttttcttctcttgaatatatcttaacgccaaattttgagtgcttttttgttacccatcctcatatgtcccagctagaaagaatcctgggtcggagctac

SEQ ID NO: 33826 - DNA, 379 bp, Homo sapiens
  misc_feature 15: y=c or t
  misc_feature 134: b=c or g or t
  misc_feature 278: s=g or c
  misc_feature 301: m=a or c
  misc_feature 302: n=a, g, c or t
  misc_feature 303: r=a or g
  misc_feature 304: n=a, g, c or t
tttttgagacggagytcactctgtcacctagtctggagtgcagtggcgcaatctcggcttactgcaagctctgcctgccgggttcacgccattctcctgcctcagcctcccaagtcgctgggactacaggcgcbcgccagcacgtccagctaatttttttattttttgtatttttagtagagactgggtttcacagtgttagccaggatggtctcgatctcctgacctcatgatccgcccacctcagcctcccaaagtgctgggattacaggcgtgasctccgtgcccggcctccaatagmnrncttatctataaaatagggattataataatatactgctgatatatgttgtaaacagaatagtatgaaagtaaaatt

SEQ ID NO: 33827 - DNA, 120 bp, Homo sapiens
aggctgaggcaggagaatcacttgaacccgggaggtggagcttgcagtgagccgagactgcaccactgcactccagcctgggcgacagagcgagactccgtctcaaaaaaaaaaaaaaaa

SEQ ID NO: 33828 - DNA, 86 bp, Homo sapiens
caccacagaaagtccccttgggctcttttctaattggtctccaccccaggcaacctctgttttgtttttgtgtttttttttttttt

SEQ ID NO: 33829 - DNA, 196 bp, Homo sapiens
taaatgatttataagtagctttattattctagtttttgtggatttttttatgacattcccttgaggtattcagagattcttttggacattatcagggcaaagaaggtgatacactataaaaggtttcatgggagttccagggaaccctgtgatggtgacaaactgtgacccagtatattcctaaaaatagagagat

SEQ ID NO: 33830 - DNA, 263 bp, Homo sapiens
ccattggcctatgtatctatttttgtaccagtaccatgctgttttgtttactgtagccttgtagcatagtttcaattcaggtaatgtgatgcttccagcttgattttattttattttatttttttttgcttaggtttggcttgactacttggtctcttttttggttccatgtgaattttagaatagctttttctaattctgtgaaaaatgacattggtaatttgataggaatatcattgaatccatagattgctttgggcccc

SEQ ID NO: 33831 - DNA, 184 bp, Homo sapiens
gcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacacccctc

SEQ ID NO: 33832 - DNA, 338 bp, Homo sapiens
tagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaa

SEQ ID NO: 33833 - DNA, 342 bp, Homo sapiens
aaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggat

SEQ ID NO: 33834 - DNA, 329 bp, Homo sapiens
aaccaggaacctgagcacccataaaacagcatttgcctgaagtccttctgaggccagcccatgtatgggttatgtgtcctatgtgtctgctgcctccccactgcctcgggccagtgcagtctagtgcagaggggcttgttggcagaggccatccccctgtgagaacaggctgtcttgcccctctgctaatggtgaaatgtccagagccaggaaatcagaaatagcgtgatgtagaggcacccctgagcaccgttgctcgcactagggcccctcctgagtaggcccagccacctggcctgccttcctcttctcccagctgagccacccac

SEQ ID NO: 33835 - DNA, 279 bp, Homo sapiens
caagaaatttagcacttcctgactgcttttcagcaagcaggcctcaaaccaacttagtggttggaaccaataatattgaatttttaaagtaaaaggctagcagtagaacatctacatctctttctatcagtatgatatttatcagtctcttttggtaatccatgactagcttcaatctttgccttatgttggtattaaagctatcattctttcttgaattttgtagggcatcatttttgcaaagcaaaaagagaatgcactatagagtgtgaccccaga

SEQ ID NO: 33836 - DNA, 164 bp, Homo sapiens
  misc_feature 157: h=a or c or t
  misc_feature 158: r=a or g
atagctgggactacaagcgcccgccaccacgcccggctaatttttttgtatttttattagagacagggtttcaccgtggtctcaatctcctgacctcgtgatctgcccgccttggcctcccaaagtgctgggattacaagcgtgagccactgcgtchrgccatc

SEQ ID NO: 33837 - DNA, 74 bp, Homo sapiens
cattccaaattttctatgacaaggtgttcctacctcaacaggtgatcaccatggcaacgaggtagtctgttcta

SEQ ID NO: 33838 - DNA, 150 bp, Homo sapiens
  misc_feature 83: r=a or g
  misc_feature 92: w=a or t
  misc_feature 97: r=a or g
  misc_feature 124: r=a or g
taccttgaataagatttgggttgtcttaatttatattcaagtagacataaataggttgcttcacttctcaagatattaagtgractgttttwaaagrcttgcgattaacttctttggtagctargtaatcacttagttgaacttctgggc

SEQ ID NO: 33839 - DNA, 148 bp, Homo sapiens
gaaaatgatgttgtttttatgaatgggctccttactattatttttgttcaagtaacaaaacatgattcaaagcacccatcttcaagagcccagcctcatttcctgacacctactcagtcttctggaataaaggctcagccaaacaata

SEQ ID NO: 33840 - DNA, 166 bp, Homo sapiens
  misc_feature 14: s=g or c
gctgcgcacagatsattgaattgcggggttgctgtaggaaccgctgctattgccgcaggaggagatgaagttatcttgtgcaggctgtgcagacacagccattttgggactcagcactttccttaatttactttccatcaacctgctcggaatgatttctttctct

SEQ ID NO: 33841 - DNA, 175 bp, Homo sapiens
tctgctcaagcaattgtttttcagatattggaattcagcaaagagtgacctctctggccattctaaaactttaatgttgtgtcctaaatctggtggaggaaaagcatgcgctgttgaaccaagctgctcactggacacatatttgtgtccccaggagattatttgtcagggcacc

SEQ ID NO: 33842 - DNA, 317 bp, Homo sapiens
ttggtatcttttctgcttcttgttaattaatggagagcatttcatctttttttccccataatctgaaatcatgatgtaacattgcaattctgtgttctttaaaggttgtataacattctgctgtgaaaccatctggttttgtatctttctgttgtgtctgtgttgttgggatgttcaagtgtgatgtgctttttctggggtcaattttggttaagtgatttgcttggaaatcattttctctaggttttgattggttgtaaatctgtatctgtgattgtatttttcctcaattctgtttattatttggctttttcttt

SEQ ID NO: 33843 - DNA, 50 bp, Homo sapiens
cctaatggctccactgggcttccataccagccctttccagtgtcttaaca

SEQ ID NO: 33844 - DNA, 68 bp, Homo sapiens
  misc_feature 57: m=a or c
acttcttttattctctctctttagaagttcacagtgttatataagtcaaaaacaagmcagaaaccacc

SEQ ID NO: 33845 - DNA, 157 bp, Homo sapiens
  misc_feature 91: w=a or t
  misc_feature 92: w=a or t
tttttaagggaaagacccggaaacagcacattctctttttccagtagccggaatttgcaactacatatagtcgcaaagaagactgggaggwwatctttagttgggaagcaatgagtctagcaaaatctctgtttttaagggtggcaaggggactggg

SEQ ID NO: 33846 - DNA, 320 bp, Homo sapiens
  misc_feature 103: r=a or g
ttgactcacgattatagtcataggtatgtcctttttgcccatttcattatagtcaagtttgtttcttcctgtgtttcatatttattttcaaattaaaattgarggttacagacaccttcctctccttcctcctctcactaagcttgtttctgtatgtctctagtctttggtttattgacttaaaatccagggccttgtttgtcaaactatctttgtcaaacttctgtcattgagaagccctcaataatgcaggaataattatatccacacagcttctgcttacgtgggcatttttttttctttctttctttttttttttt

SEQ ID NO: 33847 - DNA, 389 bp, Homo sapiens
taattctaacttttgctctaggccttccttgcagattcttttcattctgcatttgcacattctgtatcttcactagctgaatctccctattcttttgatcatcagcttctaagacttctgtctcctgccccatattattttcttatttcctcttttctcagaaattcccctttagcttttcatatttctgcccccactggaaatctgtggctcaactgatagactttttttatctccaactttgtccatttgtcacctttttatagcaaatactactgtacaagttagggataaaattaaaatacatattcatcatgttaaaactccattgacttctataaagtataattatactttaatgtgtatttccacccctcttctcccccttc

SEQ ID NO: 33848 - DNA, 342 bp, Homo sapiens
  misc_feature 99: s=g or c
  misc_feature 102: s=g or c
  misc_feature 104: s=g or c
  misc_feature 112: r=a or g
  misc_feature 114: d=a or g or t
  misc_feature 330: r=a or g
attatgggatgtgacactgggttgtgttgggagtattatggtatgtttggttgaccacgggctccttgcaattattatgggatgtcaggatgtgggtasgasastaaaattrtdatgggatagctttccagtgttagaggaaaagagattagatgtccatctgtggggcgacagtagggctgttgatcattatgggttatctttttgatagaggaggggtacttactataggctgtggagctagaagagggaaggctgggggtgatgtgagcctctagaccctggcctgcagggactgagggcagctctagggggttagttattatgggrtgtcagtataga

SEQ ID NO: 33849 - DNA, 197 bp, Homo sapiens
ataactcacagaccaaaccccttccagcagagggcagtgcctctgatacgacacagggcccaggccagctggagccagagctggggacttcgctggaagagaatggcaccggcctgaggtcaaggagaaattgaactaaactctcctttgaagactgtttccagaggcccgttcccgaagccggagtcccgaccctc

SEQ ID NO: 33850 - DNA, 212 bp, Homo sapiens
caaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaag

SEQ ID NO: 33851 - DNA, 112 bp, Homo sapiens
tcgaagctaacatttatcaagctcttactgtgtccatggtactgtgctaaatgctttatgtatactaaatcattgaaccctagcaaaatttctatgcagtaggtatcgttat

SEQ ID NO: 33852 - DNA, 71 bp, Homo sapiens
  misc_feature 14: m=a or c
  misc_feature 23: v=a or c or g
  misc_feature 31: m=a or c
cctgcaagacctgmaagagggtvaacaggamagagctcataatggccaaacctggaacaatttgagcaaca

SEQ ID NO: 33853 - DNA, 97 bp, Homo sapiens
ttaaaattaaaagagcatccggttttggtatggggatgatccaggattatgttgtgactgatacatattagttacttgtgctttttttttttttttt

SEQ ID NO: 33854 - DNA, 56 bp, Homo sapiens
agtgattcggccgccgcgccggggggtgggggggctgcgcgggacttttttttttt

SEQ ID NO: 33855 - DNA, 277 bp, Homo sapiens
tcaaagataaatattacagtataactgtcaatgcaaaggaggcaaagactatgatttaggctaaagatagcatcccgatctgttttctcctcgtggtccctgacttccatctcatagggactatgcctttttagttttcttaaggataccaaaatatgtctgctaaaatattctctttcctgcaatagtattttttaaaggtataattatttattccattcttcataggcatactttccagtttctctttcccacacccattctttgaggaacagcc

SEQ ID NO: 33856 - DNA, 224 bp, Homo sapiens
tctttcagtttgcactgggtttcaattcagtggatcaactaatgtgaattgttcttgttagatataggtcttaactgagtaaaagaaacaaacctattctaacctagtatctcttaacctctaatacaaagctgcaataccggcaaatcatggaattcctcaaggagctggaacgaaaggagaggcaggtgaagttccgaagtggaaacccaaggtggcgatag

SEQ ID NO: 33857 - DNA, 259 bp, Homo sapiens
ggagaatcgcttgaacccaggaggcagaggttgcagtgagccgagatcgcaccattgcactccagcctgggcaacagagtgagactttgtctcaaaaacaaaacaaaacaaaaaaatatttttctcatcactttctcaagcctggacaaacaacagaacaacaaatccagtcctgagttatagcatttgccagtttctgtaatgtaaatattcccaggatgtctaaattcaagctgtagacataatattactgagaggc

SEQ ID NO: 33858 - DNA, 146 bp, Homo sapiens
  misc_feature 95: k=g or t
  misc_feature 106: y=c or t
  misc_feature 111: k=g or t
  misc_feature 117: w=a or t
  misc_feature 129: y=c or t
ttttctaagaggtttcttaggtactgaattttgcctattgcttttttttttgcaagagttcatgattatgtgattgttacctcctttagcttgtkgacatgatttyctaakattcawtcaacttgccayccctgcaataaaccccc

SEQ ID NO: 33859 - DNA, 346 bp, Homo sapiens
  misc_feature 313: r=a or g
cttttaaaaatctaaggccaggcgtggtggctcattcctgtaatcccagcactttgggaggccgaggcaggtggatgacttgaggtcaggagtccaagaccagcctgaccaacatggtgaaaccccatctttactgaaaaaatacaaaaattggccgggcatggtggtgcgtacctggtcccagctagtgcagaggctgaggtgggagaatctctttgagcccagatcgctccactgcactctagcctgggtgacagagtgagactcttgtctcaaaataaatataaataaaaatctaatgtggattaaacgraagaaattgttttctgctctactcccggcatac

SEQ ID NO: 33860 - DNA, 296 bp, Homo sapiens
  misc_feature 155: r=a or g
  misc_feature 166: w=a or t
  misc_feature 168: w=a or t
  misc_feature 179: k=g or t
  misc_feature 186: k=g or t
  misc_feature 189: d=a or g or t
  misc_feature 191: k=g or t
atacaagatttcaaagacttaattttttttaaaagaatgtaagttatctcaattttttatattgttaatgttgagatgatattctggatattttgagtttaatcaaacattaaaatgaaattcacctgttttctttatactttaatgttactagrcactttaaaawtwacctaaatggkggcttgkgtdakatttcattggaaagtgctactctgtgacttttaaaaggcagcagatgtattctgtagagaaagcagtagttctattaaccaacctggttttgttttaaattagaa

SEQ ID NO: 33861 - DNA, 138 bp, Homo sapiens
tgttttatgtttttaagtctttgactcaaatttcagttgaaatttggttcatcagtaagcatacatcaaaggcagttttacctcaagatgatattgtgtactttaacaaaagtgtaactattttttatcccccaccca

SEQ ID NO: 33862 - DNA, 265 bp, Homo sapiens
  misc_feature 165: k=g or t
  misc_feature 168: m=a or c
  misc_feature 173: w=a or t
ctctttctctggacccaacatgatgtaacagggcactttttatgtttaacttaggacaaatgatcctgcctctttcccccaccatgcacacatcctgaacatcatattcttccttgttcaatattaaattaaggctctgtagtaataatgtgtatgctcagtgtkgcmaaaawtaaaattttacatattgatcaagatttggcagtacacctatggattgcacatggtacactcattggaaaatcactgattttttttttttttt

SEQ ID NO: 33863 - DNA, 158 bp, Homo sapiens
  misc_feature 2: n=a, g, c or t
  misc_feature 8: w=a or t
  misc_feature 20: v=a or c or g
  misc_feature 26: m=a or c
  misc_feature 34: m=a or c
  misc_feature 71: r=a or g
  misc_feature 77: r=a or g
  misc_feature 111: h=a or c or t
anttgggwgtggacacaggvacaaamcatatcamatgtgtattctgctgttgttctataaatgtcaattaratccarttgattgatgatgctgttcagttcaactatatchttactgattttttttgactactgaagcatctatcaattaatgatgga

SEQ ID NO: 33864 - DNA, 113 bp, Homo sapiens
taatgcaggaacagaaaaccaaatactgtatgttcttacttataagtgggagctaaacattgagtgcacgtagatataaaaattggaacaacaggcactgtagaagggggggc

SEQ ID NO: 33865 - DNA, 192 bp, Homo sapiens
  misc_feature 172: n=a, g, c or t
tcctggcaacctccctgccctaaaagaagattctccttagggctcctccaggcacagcccctgacccgtatttaggggacatccatggtgggtgactcaccactgtccaccccaagaagcagagacccagccgaggacctgccctgggccccttccccggggcaaccttccnggcccccctctgtgcccaca

SEQ ID NO: 33866 - DNA, 152 bp, Homo sapiens
  misc_feature 105: d=a or g or t
tatcagttctaagcttgtccgaatggacttgtagagctataagcacgtgtaccaccttctcaggaaggtggccgctccaatgctctctgactctaaaggaatgadatgattattcccacccgaacatccatcttctctgggtttaccgtccc

SEQ ID NO: 33867 - DNA, 113 bp, Homo sapiens
  misc_feature 3: w=a or t
  misc_feature 4: k=g or t
  misc_feature 101: k=g or t
  misc_feature 108: s=g or c
tgwkgatgtacttatattttgttttgctattaacctacttacggggttagggacttgcggggggggcttgtgtgttttgttggcttgtttgccatggaagktaagaastgggt

SEQ ID NO: 33868 - DNA, 198 bp, Homo sapiens
  misc_feature 7: y=c or t
  misc_feature 98: m=a or c
  misc_feature 110: m=a or c
  misc_feature 188: y=c or t
  misc_feature 189: w=a or t
tatagayacataaagggatggaaagagatattccatgtaatgaaaccaaaaaagagcatgcataactatagttatatcagacaaaataaagttcaggmcaactataagamaagacaaaggttactgtataatgataaagggctcagttcagcgaggccataacaattgtgaatatatatgcatctaaywctggggcct

SEQ ID NO: 33869 - DNA, 167 bp, Homo sapiens
  misc_feature 92: w=a or t
tgattattatagccaggacctctgtgaaatgactctaggatgagaactaaaatataatggaatgggagaggttcattcattatgttagagawttgggatagtgctaggcctttaattaattaacatttcattaataatctgtaaggagtaccagtaaacagcacttt

SEQ ID NO: 33870 - DNA, 382 bp, Homo sapiens
  misc_feature 100: k=g or t
  misc_feature 327: r=a or g
agtatccatcacagttatttgcactctgaccatgttggtgctcactagagtggtgatatttcacctgaagaagtgaaagacaggaagtggatgggttgakgagtgtgaactgattggcaaatagaatatccccaaaacagagcaaacaagaatgccagtgctctgaaaactgccttaaatataataatagggaactttctttctctcttcaagcaatagagaccacagggaactgcacccacctgcaccatcgccatgccagtggtgctgccattctgagattatttcacacagtcagattcagtacacgcagtcatttgtttaaartaaatagaagaacattcctttgtgcagcttgtcccctggaataaaaatggccccc

SEQ ID NO: 33871 - DNA, 64 bp, Homo sapiens
  misc_feature 22: s=g or c
  misc_feature 23: k=g or t
tcgtgattgtctccctgtggaskgattgctgtagggctgcggaaagttgctggacactgccagc

SEQ ID NO: 33872 - DNA, 210 bp, Homo sapiens
aaatcaagtcatgatggatcaataacttaaatgtaagacctgaaactataaacattctagaagataacactggaaaaaccattctagatattggcttgggcaaagacttcatgaccaagaacccaaaagcaaatgcaacaaaacaaggataaataggtggaacttcactaaagaacttctgaaaagcaaaaagaacagtcagcagaaact

SEQ ID NO: 33873 - DNA, 132 bp, Homo sapiens
atcttagtaatttttgattataggggatgagggaggaattggacccaaggtaggcaccaagttctgaaaggacaggacagaagttaaatggcattttacggagtttagagtttatcacataggtacaggggt

SEQ ID NO: 33874 - DNA, 161 bp, Homo sapiens
agttggccagggtaaatattcagtcgtctcaggtaataggtgaggccatagagctcccacaagtttatatcttttgtctctggttaccaggaagggtagagaaaaccatcaggtgggggcagggttaggcaggtctcagcctagactctccttgggcttgc

SEQ ID NO: 33875 - DNA, 62 bp, Homo sapiens
gtactggctcagattggttgaaatacaaacgcttgttttccttttttttttttttttttttt

SEQ ID NO: 33876 - DNA, 110 bp, Homo sapiens
tatgaatttctcctatttgctctagcatgcttacagaaaatgtcagtgtttcttacagctcaaatttgtatagttgttttaaaatgcggtctctttcttcttcccctcgt

SEQ ID NO: 33877 - DNA, 240 bp, Homo sapiens
  misc_feature 180: d=a or g or t
cactgtgatctgtgggtctttgagtttcagtgagtttgctgaaatgtcgaagaagtagttccaaacttcaatgttcaatgaaatttttgttcaagtttgaaatggagagagcagctttaaaaggtactaagccttttacaaattggtgagtactggcacatgagatctagagcaggagcdacttctcacacatagtaagtgggaaaagaaagtgctttgaaagttcctccctcacctact

SEQ ID NO: 33878 - DNA, 218 bp, Homo sapiens
atagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacct

SEQ ID NO: 33879 - DNA, 101 bp, Homo sapiens
tcacccatttaagtatacaatttagtgacttttagaacatttagtgggttatgtcaccatcactataatcctgttttagaacatttttgtcaccctcatac

SEQ ID NO: 33880 - DNA, 384 bp, Homo sapiens
tcaaacttctgacctggtgatccgcccatctcgggcttccaaagtgctgggattacaggcatgagcctccgctcccaaccccttattttttaaatgtaaggaaaacatttcatttattcttagagactactactctaccttgagactgcagagcgcagtgcatataacaccatgcattatttgttcttttcttatactgaacatttatagaaagaagtttttcagctactcctgcatcctcaccatgagtaccttctgtttccccagcctttggagtttctaggaagttacattacttagctacttgtttcatctaccgatatatccagtttcactctcttccaatctgttcaccatattgcagtcagtaacctttttgaaatt

SEQ ID NO: 33881 - DNA, 219 bp, Homo sapiens
attagcagttatgcaatggacctgattctagtttattctaattaagaagtgaggccgagtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcagaacc

SEQ ID NO: 33882 - DNA, 158 bp, Homo sapiens
ttgtgtttaaaatttttctccccttcttcagtcagccaccattcactcttccagagctgttagtggctctaggattaatgctgttcttctgtagcaggaagagatgaatggagatttccctttgtggcctcctcaggagctataatgagtaaaggctt

SEQ ID NO: 33883 - DNA, 349 bp, Homo sapiens
ctaccaatggaaaatgcagctcttgaggatgacgattgccaaacaaaggctcggagacgaagcaatcggcgtgcgacactttgcagcccatgagcgtgaagacttggtgcagcagctagagcgagctaaggaacaggttctcactaacatctattcagagtgggggatgcatttgcacagctggacacaacacaaacaagagtggactgtgcccctcgtttctcagagtatggggtgcctgggatgcacgttgaatgcttttacttcctcagcactgcactagggtcccaagctgactcttgggtttctggcctccagcaggcaggtctgctccctgctattgggtacc

SEQ ID NO: 33884 - DNA, 427 bp, Homo sapiens
ccataaaaatgctgtaccattataaatattttatatctatttgggcccaatttttaaaatactgtatcctagttagaatagaaagataaaagagaaggccatctaagggggcttctcccaaattattcattaatgttcagttgtttatagcagaagattttgttgttgcctacttatgcataaacctcaaggctgtagcaaccactctcttatagccagtgtgtgtgccctagcataagcttctaactatggactatttctttactgatatcattcagtatagggataaatcaaatgtgcaaaaagttagaataaatttgtgatctgtagttgatcatgtcttcctcatgagcatccacctagctgctataatgtgggatataggggttcatcacaaaattttaaattagtaattaatgatatctgt

SEQ ID NO: 33885 - DNA, 314 bp, Homo sapiens
ccttatgtctctctctgcttcttacggccgctgtccctgaatgtttcttccctgtctgggtctgggctgtgggcttcctgcagagggctggggggtcctcaccccctttttctccccgcagaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatcccgcagct

SEQ ID NO: 33886 - DNA, 169 bp, Homo sapiens
atatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacactt

SEQ ID NO: 33887 - DNA, 329 bp, Homo sapiens
  misc_feature 189: b=c or g or t
  misc_feature 190: m=a or c
  misc_feature 246: n=a, g, c or t
tatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggbmagtgcatccaaaacacattcaggaaacccgagagttgtaagttgcacatgtgtggnctacagtgacttccatgtagtaacagggctgagcaaggcaggctctccaccagacttaaagcattcaaccactctgcccctta

SEQ ID NO: 33888 - DNA, 195 bp, Homo sapiens
taataataatttcttatgatcagctactaccccatctgtgttcaattttctctaattatctcaaaaatgtcttatttggattggtttctttgaatcaggcagaagaacatagaagctgtgctctctcaggcctctgtctatttccatagtaatcatatattgacatatatcattgccaccatcttcaccgcccaa

SEQ ID NO: 33889 - DNA, 161 bp, Homo sapiens
  misc_feature 47: w=a or t
  misc_feature 118: k=g or t
attatgaatgggagttccctcatgatttggctctctatttgtctgtwattggtgtataggaatacatgtgatttttgcacattgattttgtatcctgagacttgctgaagttgcttakcagcttaagcagattttgggttgagacgatagggttttctttt

SEQ ID NO: 33890 - DNA, 134 bp, Homo sapiens
tctaggatttgcaagggtaattttgacagcgtatatgccttattcactgaccttcggacctaactcctgtgttaagatgtgactctactgtacttgtcttttacagttttctgggtctgactctgggaggacca

SEQ ID NO: 33891 - DNA, 195 bp, Homo sapiens
  misc_feature 89: w=a or t
tcaaaaacttttaatgtcattctttagatagttaagtgctggttatatttgaaggatatgcattttgtgtttgtggggatggtatgttwaaatgtcttacacttgttgtaatattggctagaattgctataaggtcacacacaaagtggaacctaagacttttggaaaacccgggatcttctaaatctagtgcaa

SEQ ID NO: 33892 - DNA, 309 bp, Homo sapiens
aggataatacagttcctgctaaaccaaactgataaccaatcgttaggggctgaattgtgctcctcatcttcccaaattcgtatgttgaagtcctaacccccagtacctcagaatgtgactatatttgaagatctgcaaagagctaattaaggttggatgaggttcacagggtgggccctaatccaatatgattggtatccttaaatgaagagttgattagggcacagataggcagctctgtctcacagtgctattgtgtggattaaacttgttaatatacataacaagtttgtccagcccgcagcctgt

SEQ ID NO: 33893 - DNA, 56 bp, Homo sapiens
tcttcaaacaaacaaacaacattctgaaattaatattttctttcttcctttttttt

SEQ ID NO: 33894 - DNA, 213 bp, Homo sapiens
aaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggccctaca

SEQ ID NO: 33895 - DNA, 94 bp, Homo sapiens
taatatttaataggtacagagtctcagtgtgagatgatgaaaaagttctatagttggactggtgatggctgcgctttacacttaaaaatgactt

SEQ ID NO: 33896 - DNA, 217 bp, Homo sapiens
atctatccttcaggcgcgcctctcctctctcggactttcacaaccaccagcgacatcaatctctcgcttcctgctccacttctcggcgcccacatctccaactggctcaggctccccatgtccccagccggtacggagctgcggtcagcggattgtgcggctgagccatcctcgtgacggtcccgcctcactcaccctccgtcacctccagcaccct

SEQ ID NO: 33897 - DNA, 181 bp, Homo sapiens
aaaaaattaaaagtggtctgaccctgacaggaggatgtttttttttgtttgttttttgtttttttcttttgagatggagtctcgctctgtcgcccaggctggagtgcagtggcacgatctaggctcactgcaacctctgcctcccgggctcaagcagttctcctgcctcagccccccgaat

SEQ ID NO: 33898 - DNA, 345 bp, Homo sapiens
  misc_feature 91: r=a or g
  misc_feature 198: n=a, g, c or t
  misc_feature 202: w=a or t
  misc_feature 282: n=a, g, c or t
  misc_feature 283: n=a, g, c or t
  misc_feature 284: n=a, g, c or t
taacacattttcctagtagtgatagaattttcagggaagcaagaaaccaagaaaattctggctgctacctaattttaatgaagttggcgarttatctgcccacaaggtatgagaagtatagatgtgcattgctctacaaatatacaacgcaataaggcccactcgaaattcatgaaaggcttgccaagccacatggcntgcwtggtcgtaggtagatgcatgatgtccctcttagaatgaggcccatgtttaaaatccacatttacaaaaggagtaggtacnnntgtgatgttttgaggtaaccaaagtgtgtcatgaaaaagaacgtcaagaagaaaggcatgc

SEQ ID NO: 33899 - DNA, 64 bp, Homo sapiens
  misc_feature 12: s=g or c
agatcctctcasctcagcctccccagtagctgggaatacaggcatgtgctacaaaggctaattt

SEQ ID NO: 33900 - DNA, 167 bp, Homo sapiens
  misc_feature 77: r=a or g
  misc_feature 80: m=a or c
ttctctgtgacctcaattctctgatccaccctagaagggttgactttcagtttgttcagcctttttctagctgtgargamcaagtgatgactgcctagctctttccatgttgaaatagaaacccaaaagtttgtttaaagaattacttgttataaaagtcccccctt

SEQ ID NO: 33901 - DNA, 186 bp, Homo sapiens
atctctcccgccctctccagagtcgactgaagtttccgaggagacttctcaggctgggctggacacacctttccaaggaccccccaaactctgctccgtgcacgtcaaatgctcctttcccttgtgtccaaccccctacccctctccctaacacccctcttctcaacaagactcagcctctcccca

SEQ ID NO: 33902 - DNA, 83 bp, Homo sapiens
ctcagcaactggggtgaagcgcacaactcgtccgcccccgagtgcccaacttaaccgcggctccgttctccagcacccgctgc

SEQ ID NO: 33903 - DNA, 280 bp, Homo sapiens
  misc_feature 85: k=g or t
  misc_feature 230: n=a, g, c or t
tacatttgtccaaacccataaaatatgcaccaagcttgaaccctaatgtaaactatggactttgggtgatcatgatgtattaatkgcaggcttactaattgtagcaaatgtaataatactctggtgggggatgctgatggttcgggaggctgtagcggaaaggggtacaagggaactctgtactttctacttaattttgctatgaaactaaaacttctctaaaaaataangtctgttcaagaagctaaaaaattagtatgcactgttctctctgccccac

SEQ ID NO: 33904 - DNA, 313 bp, Homo sapiens
  misc_feature 86: k=g or t
  misc_feature 91: k=g or t
gtccgtctcccgggttcaagcgattcccctgcctcagcctcccgagcagctgggattacaggcacccgccaccacgcccagccagkttttktgtatttttagtagagatggggtttcaccatgttggccaggatggtttcgatctcttttttttttaattttattattattatactttaagttttagggtacatgtgcacaatgtgcaggtttgttacatatgtatacatgtgccatgttggtgtgctgcacccattaactcgttatttagcattaggtatatctcctaatgctatccctccccggtcccccc

SEQ ID NO: 33905 - DNA, 346 bp, Homo sapiens
  misc_feature 100: k=g or t
cttccacgatggttgaactagtttacagtcccaccaacagtgtaaaagtgttcctatttctccacatcctctccagcacctgttgttttcctgacttttkaatgattgccattctaactggtgtgagatgatatctcatagtggttttgatttgcatttctctgatgtccagtggtgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattggccctttgtcagatgagtaggttgc

SEQ ID NO: 33906 - DNA, 102 bp, Homo sapiens
  misc_feature 90: n=a, g, c or t
aacatcaactgtggttgtaagagtaaatgtttcaccttaagataaacatgggcaatatattaaactctagtctgttttcttgcctgtgangtgaggctgcac

SEQ ID NO: 33907 - DNA, 192 bp, Homo sapiens
  misc_feature 92: k=g or t
agtcgaggctgcagtagggtatgagcgggccactgcacttcagcctgggcaacagagcgagaccttctgtctaaaaatatttatccataatkgagtgaataaatgaatgaatggattattttagtttggcctcaatctttatagaaactcaattcaacaaacatttgagcacctgtttgttcagggccacgc

SEQ ID NO: 33908 - DNA, 393 bp, Homo sapiens
  misc_feature 52: m=a or c
  misc_feature 121: r=a or g
  misc_feature 234: k=g or t
  misc_feature 283: w=a or t
  misc_feature 285: n=a, g, c or t
  misc_feature 286: d=a or g or t
  misc_feature 287: k=g or t
  misc_feature 310: b=c or g or t
  misc_feature 374: n=a, g, c or t
  misc_feature 377: v=a or c or g
  misc_feature 384: b=c or g or t
tgggtttggttttggatttagtacttgggtaactttgagatgttcaagaggmaatattgcttacatggccacctaggtctggaaacagaaggaaagacagaggctttcctctattgtgagraacctgcatgccccgagcgggtctcataatggcttaaaatgataacggtctagggaggaatgtagagcaagaagagaagttaatgcctggagaagaatgaattttcttttctkttcttttcctttttgagatggagtcttgctttgtcacccaccctggagwgndkttggcatgatcttggctcactgbacccttcgcctcctgcattcaagcgattctcctgcctcaagcctcccaggtagctgggatacanggvaacccabaccacgcaa

SEQ ID NO: 33909 - DNA, 123 bp, Homo sapiens
  misc_feature 89: s=g or c
attgctctcctgccacggaggggagcgcttggtggcagtccgcgggcccggacggaaggctgaggcgacgcctcgacgacagcggaacsggagctgcaggagcaacacattcagggcgggaca

SEQ ID NO: 33910 - DNA, 317 bp, Homo sapiens
  misc_feature 159: k=g or t
  misc_feature 160: y=c or t
  misc_feature 295: s=g or c
atttcagtggtcactcccgtctttgacggggccacactcggggtgtaaattaggatcctcactgaagcggcgggaccctgagaggcctttttcctggccccttagttgtgggttttcctgcgggcggtggagcccgtttccataagaaccgcccagagkygggcgctgccttccaggggtgaagcgttttcggaccctggaatctgtgggcggcctgcggcaggggctgaggcgcagttccctactcacccagatccgaatccaccgcggtgctgtttccagcgagtcagattcsagatcgcgctccagcctggaca

SEQ ID NO: 33911 - DNA, 332 bp, Homo sapiens
ctgagttaaattctagaaaatttagcaccttttatactcatatagctgtgacaataactttaaatatgtgaacattaggaaattcaaaagcttatatattcttagaagctaattttgaccacgtgcgcaaattatttttcttttttagtagaatggtgcattttttgcctttgtatttgaaatttagctaaattacaatagctatcagaactacaattgaccttagtaatttcaaaaccatagttataagggttttaagttgatttttaaaaatcttaagatatgatagggatttcaaaactatgtgtgtgtatctctgatagggaggggga

SEQ ID NO: 33912 - DNA, 161 bp, Homo sapiens
  misc_feature 92: m=a or c
  misc_feature 133: m=a or c
caagtaaaagacagcatgcttttgagtcaccaggcacatgctctaaccattccaaacaatgtcagtgataaaatacgcccacctgtccaggmtgactgctcctccacccccagccctcagcatgtcactggcmagatatctgaaggttttgagggggtaag

SEQ ID NO: 33913 - DNA, 232 bp, Homo sapiens
  misc_feature 231: k=g or t
tagtcccagctacttagaaggctagggtgggcagactgcttgagctcaggagttcaagaccagcctggacaatatgatgaaaccccatctccacaaaaaattagctgggcgtggtggcaggtgtctgtagtcccagctacttgggaggctgtggtgggaggatcgcttgagcacgggaggcggaggttgcagagagccgagattgcaccactgcattccaggccgggcaaka

SEQ ID NO: 33914 - DNA, 270 bp, Homo sapiens
  misc_feature 218: k=g or t
  misc_feature 232: k=g or t
  misc_feature 241: r=a or g
  misc_feature 243: r=a or g
acttaactatttcactgatctatatgtcaatttatgctggtaccatactgccttgattactgtagctttgtcgtaagttttgaaatcaggaaatacgagtttttcttttttgttctttttcaagactgttttggttattaggggtgccttgagtttccatatgaatttttgcatcatcttgtcagtttctgtagagagactggctgggtttttttttkgtttgtttttttgkgtttttttraracggagtctcgctctgtcgcccaggca

SEQ ID NO: 33915 - DNA, 370 bp, Homo sapiens
  misc_feature 91: k=g or t
  misc_feature 98: k=g or t
  misc_feature 299: k=g or t
  misc_feature 308: r=a or g
  misc_feature 328: k=g or t
  misc_feature 352: k=g or t
  misc_feature 355: k=g or t
cttccacgatggttgaactagtttacagtcccaccaacagtgtaaaagtgttcctatttctccacatcctctccagcacctgttgtttcckgactttktaatgattgccattctaactggtgtgagatgatatctcatagtggttttgatttgcatttctctgatgtccagtggtgatgagcattttttcatgtgttttttggctgcataaatgtcttcttttgagaagtgtctgttcatgtccttcgcccactttttgatggggttgtttgtttttttcttgtaaatttgtttgagtkcattgtagrttctggatattggcctttgkcagatgagtaggttgcgaaaattktckcccatgttgtaggtt

SEQ ID NO: 33916 - DNA, 157 bp, Homo sapiens
attagagcactgtgaaaatttagaaacttgggacagttgtacactgtcatattttttatgttttatgcatacttcatctttatccagctttatcactcccagtaggttgtgaattatcgagaggcatgcatttgttcatctttttgttccagcctta

SEQ ID NO: 33917 - DNA, 344 bp, Homo sapiens
  misc_feature 62: w=a or t
  misc_feature 131: b=c or g or t
  misc_feature 301: k=g or t
  misc_feature 304: v=a or c or g
  misc_feature 314: r=a or g
  misc_feature 316: k=g or t
  misc_feature 319: n=a, g, c or t
taaaattttcattattttctctgggcacggtggctcacgcctgtaatcccagcactaggggwggctgaggcgggcggatcacctgagggttgggaattcgaggaccagcctggccaacctggggaaacccbgtctctgctagaaatgcaaaattagctgggcatggtggctcatgcctgtagtctcagctactcgggaggctgagtcaggagaatcgcttgaacctgggaggcggaggttgcagtgagccgagatcaccccattgcactcctacctgggcaacaagagcgaaactccatckcavaaaaaaattrckaantatttatgagtaacaaaagcccctc

SEQ ID NO: 33918 - DNA, 256 bp, Homo sapiens
tgtgggagagctggtgggtccatgcatggttagttaagtctaggcatggataaaccaggtgggattgggcctgactgtatcctgacaggtgggaaggggcctgtcatgtccagatgaatggggcatgacctggtatgctgggctggcagaacacccccaccaaccctgggtagacagagtggggccaggtgttttcaggtggtcatgcatgtcggtacagatcaggcagggctgagcattcctggcaataaggggc

SEQ ID NO: 33919 - DNA, 293 bp, Homo sapiens
tgaacattagaatgaaattcatgagctattcagtggggacaggaaacttacttgagttgtttgaaatacagagaattaatttttgtttgtgttagaacatactttgctcaaagacttctgactaagatagcaatctttttgattgacaccatacatgttttgtagaggtcataattataccttacttttattctggttgcttgttttaagaggaatgttaacaaactggagcatgctccaaggaatctgatcaagatggtaaggaagtttgaaactatgtattagaggaacaa

SEQ ID NO: 33920 - DNA, 340 bp, Homo sapiens
gccctaagcaaccaataacccacttgatgtctctatagatttgcctattctgtggatttcatacaagtcacatcatacaatatgtggtcttttatgacgggcttctttcacttattataatgttttcaagtttcgtccatattgtggcatgtatcagtacttcattcatcattattgctgaataattttccattgcgtggctataccacattatatgtatctattaatcagttaatggacatttgagtggtttctaccatttgagtattatgaataatgatgctatgaacacttgtgtgcaagttttaatgtaaacatatgttttaagttctcctgggcg

SEQ ID NO: 33921 - DNA, 163 bp, Homo sapiens
  misc_feature 101: r=a or g
ctatgtacttaagtgtgttttttgtagtggctggtaacggtctttcttttccatatttagcactccttttaggacctgttgtaaggcaggtcttgtgctarcaaatttgtctgaaaaggatcttatttctcctctgtttttggcagcttggttttggggggct

SEQ ID NO: 33922 - DNA, 224 bp, Homo sapiens
tgcctactgccccatctggtgcttatgatagcatggcatattagcatgctgcaagttcataatgtattcagggggaggaaacatcccttgcataccaattgaggcatcctctctttcagaactgcttttgaatttcaatgatgtttatatcttccaagccgcgtctgaactgagcatttccgctctgaggaataacttgagagagagagagagagagtgagagt

SEQ ID NO: 33923 - DNA, 163 bp, Homo sapiens
tgggatttaattatcagtgagaaagggatcgcttcagctcaaatctatataatttagaaggtgttttccttacttctggagtcagtgatgcagctgttagtactttacaattattgttaaacatctactgagatttttgatccgttttacaaataggcatgct

SEQ ID NO: 33924 - DNA, 219 bp, Homo sapiens
  misc_feature 100: r=a or g
  misc_feature 101: r=a or g
cctggcctcaagcgatcctcctgccttggcctcccaaagtgctgggattacaggcatgagccactgcatcaggcctgatcgaggttttaatttacagagrrtcattgttaggggttcattctttctttttaagtggaatagaccagtataatgaactcccacatatgcatcaaccagctccagtaaccaccaccatgtggctaatcctaccccacccaa

SEQ ID NO: 33925 - DNA, 343 bp, Homo sapiens
  misc_feature 296: w=a or t
tgatgatggacagcagatgtataaaaggcataaaaggatagtgttagggctggaatgtcttccccccaattcatatgttgaacctttaatgcctaatacttcagaaagagactgtgtttgaagatatggtctttacagagggaataaagttaaaataaggtcattagggtgagccctaatccaaaggatgggtgtcctaatcagaggaggagattaggacccagacacacacacacacacagagccaggtgaggacacagggagaaaatggccacgtacaagccaagatgagaggwctcaggaagaaccagccgactccacccttcaaaactgtgagaacata

SEQ ID NO: 33926 - DNA, 246 bp, Homo sapiens
  misc_feature 110: r=a or g
  misc_feature 111: r=a or g
gaaatggggaaaaagggagccaagggtttgggtatcctggagaacaaggtcctcctggtcccccaggtccagagggccctcctggaataagcaaagaaggtcctccaggrrgacccaggtctccctggcaaagatggagaccatggaaaacctggaatccaagggcaaccaggccccccaggcatctgcgacccatcactatgttttagtgtaattgccagaagagatccgttcagaaaagggcga

SEQ ID NO: 33927 - DNA, 191 bp, Homo sapiens
acttagaagtctacctggccggggtgcggtggctcacgcctgtaatcccagcactctgggaggctgaggtgggccgatcacgaggccaacagatgaagaccatccgggccagcagggtgaaaccccgcctcttctaaaaattagctgggcgtggtggaatgcgcctgtggtcccagctactcggggggctg

SEQ ID NO: 33928 - DNA, 261 bp, Homo sapiens
taggtgctaggcaacatgatagattctgagggtacaaaggtgaacttcctgcaaaaaaattgttcttagtttcttattaataaccagcatttataaaacactatttgccaactatgtgaaatactccacatgccttctttcatgtaatccttgccataatcctatgaggtaagctacattgtattcccattaacaaatgaggagactattctgtctgactcttcaatccataatgttaagcaccatgcagtaccgtctccc

SEQ ID NO: 33929 - DNA, 178 bp, Homo sapiens
ttatcttctttttttttaattgttgtgtatttgttatagattatttgggtcgaggttatatgaggcttgcaaatactattattttaggctaaaatagcaaactgtcacataaacaataaacaaacaaaaaatgaaaagtagtaaaaactctatgatttaactttattcccccacttaa

SEQ ID NO: 33930 - DNA, 235 bp, Homo sapiens
taaacattgttggaacattggtacatcagttactattattatgcatatcagttggtattctagtagtttacccattatattcccagctatcaaaacagctttatggtggtttaggagttgacagacatgttggatgataaatagtagaattatataatatttttatatttgtagatgtatctccttaaataggatggaatgatttcacagaagatgaatgaaactcaatcccccc

SEQ ID NO: 33931 - DNA, 416 bp, Homo sapiens
ataattattccctccatacaaaaatgactttgatattcagattttaataattatcagatagctataatatgtggagtgatgggaagtaacattttggacagattgcagttaggaaacagaccctggtcagaaggtcttagacaaaaatcttagcatcaagctcagattattccttcctgcttcatttgtgttctcctcacaatgctttcagctgcctaggaatagccaggcaaccagctgctactttgagcacccggctaaaataagcagagacaactggaaggcttgatgtgaaaaagagctgttgaagtgtacacaagcaagctgactgccttatgactaatacttgacagaacccagcaagaggatatgagattgcagatggatgacctcaatcctgaacagaaaggcgggca

SEQ ID NO: 33932 - DNA, 163 bp, Homo sapiens
ctatgtacttaagtgtgttttttgtagtggctggtaacggtctttcttttccatatttagcactccttttaggacctgttgtaaggcaggtcttgtgctaacaaatttgtctgaaaaggatcttatttctcctctgtttttggcagcttggttttggggggct

SEQ ID NO: 33933 - DNA, 143 bp, Homo sapiens
acattagctataaatcctttgtatgaccaaataaacttttgtattataagagtcataccctaactgacctatttttaaagtctagcttcatagtcataaacatgtgatttaaaatttcatttttctcacttcccccacccatc

SEQ ID NO: 33934 - DNA, 288 bp, Homo sapiens
  misc_feature 113: d=a or g or t
  misc_feature 259: n=a, g, c or t
cttgattatcttcaaaaggaagacttgtctacagacttatccctttgctttttttctggggtgttttcataatgtttataaaacatggacagatcacaaatctgtaacaacadtaagaacaaaaagacctgagggacttccagttgccctaggataatggtggcctcctaagctggagtttgtccacttattctcccagaaaaacatagagattaataaggaaaacaaatagaactacgtgcaacccacactttcagcnttactaggagaaacagtattatgaccttc

SEQ ID NO: 33935 - DNA, 208 bp, Homo sapiens
  misc_feature 101: r=a or g
gatcagaagatgaaaatcaaaatttctattaagtattttctgcagtcaggttattgaaggatttattgtttttgaagtaaagaatttcagataaacagaaragggccaaaactctaaaatgattaggtttctttttatcagttttgtttctgtttggtgccaacaaaagtccactagctttctgctttgttaactgagtagtgaaaga

SEQ ID NO: 33936 - DNA, 343 bp, Homo sapiens
  misc_feature 278: r=a or g
taactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatgttgaggaaattgtatggacatgcctttgtgaaaccaggaagtattttaagttaaaaatgraaaaggttttaattgctttgtgtgtgttttaatggagccccattttagaattattttttccatct

SEQ ID NO: 33937 - DNA, 245 bp, Homo sapiens
tgtgtgtgtgggtgtgtatgtatgtgtgtgtgtagctgtgggtatgagtgtaggtgtgaatgtatgtaggtgtgtatgtgtgtataggtgtgtatgagtgtagttgtgtatgtgtgtgtaggtatgggtgagtgtaggtgtgtatgtgtgtgtagttgtgggtgagtgtaggtgtgtatgtgtagttgtgggtgactgtaggtgtgtatgtgtgtgtgtaggtgtgtatgagtgtaggtgtgtgt

SEQ ID NO: 33938 - DNA, 180 bp, Homo sapiens
gatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgcacccacc

SEQ ID NO: 33939 - DNA, 285 bp, Homo sapiens
  misc_feature 215: s=g or c
atgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggasttgcagtgagccgagatcgcgccactgcactccagcctgggcgacagagcgagactccgtctcaaaaaaa

SEQ ID NO: 33940 - DNA, 110 bp, Homo sapiens
cactccagacattaatccccaccccaacagagccactggcacaagtgcccttagtgctgccacactccctggcagccaggtgccctggtgcccacccctgtcgagccccc

SEQ ID NO: 33941 - DNA, 290 bp, Homo sapiens
  misc_feature 169: m=a or c
caaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatctmgttttggcaaggatgtaagcaagaggaactgtacactactggtggaattgctcatcgataaaaccattttgaaagctggcactaaaagccaagcatatgtatactgttttacccaaaccct

SEQ ID NO: 33942 - DNA, 280 bp, Homo sapiens
ttgtctaaataggtccagttaaagaactacagggtagccatttttaaaaaaaaattttggccacgttttcaaattcacattccccctcggattagagatgctcaacctgcatcaacaaatctaaagcctacatctggctaccctggggcgagtcctgtttacagtgcccattcctggagctcgcctctttttgccttttgtttgattatgtgatgtattacttttcccagcaggccagtgctagcacactggaagagggatttaataagctggcacccgt

SEQ ID NO: 33943 - DNA, 260 bp, Homo sapiens
  misc_feature 257: s=g or c
gagttccctccttgtatcctgactaagcacggcgaatggccctgtccttgttctaaccccaggtcttgaagaggtgctgtcccagctgagccccgcgtttacaggatgaggaggcgccccagatgcgctgaaggaaaggccagagctcgtgcctccttccactgcctgcggtagagcctggtcccgcatagcttggactcggataagtcaagttctcttccatccccagaacctgcgtggccgccgcctgagcgaascca

SEQ ID NO: 33944 - DNA, 137 bp, Homo sapiens
aattgccttttttgttaaacttattttaaatgctttagtatttaaagggtgtatgttattaattaatctgcatatttgtaacgcaaataactacttcctgatttacatctcaatatattcttctttcatttgcccaa

SEQ ID NO: 33945 - DNA, 67 bp, Homo sapiens
catattgtaaatttccagtgcaggctttaatttttttttttcattagtagcactgaaaaaatattac

SEQ ID NO: 33946 - DNA, 61 bp, Homo sapiens
ttctatgttctctgtccaggcatatgtaaatatagtcagtgtttttttttttttttttttt

SEQ ID NO: 33947 - DNA, 260 bp, Homo sapiens
tatgcatctggattgagaaccataaaccaaaatggaagtttcatgtatatagtttcatccctaaatatatgtttgtggtttttatataggaccttatgagtggaaaaacttgttgtttgcttgttttttttcattgataatttgtgtcattgtgttatcttggatgagcttaaagaattgttggcaaagagattgttcctatttaatttaaaacacaagcaaactactatttcaaagacaatatgattcttacctgtccg

SEQ ID NO: 33948 - DNA, 213 bp, Homo sapiens
ctaagctttactcattttctacaaaccacagatttttaagtggatcactaattatacttctgaaaacactgtttagaagtcatttatttattattagtattaattatttcaggctaggctacaataacaaataggcccaaacacgtaatgggttctgcaaaagagaagtcttggcaggtagggctctgctttattaaatcttcaaggatcctt

SEQ ID NO: 33949 - DNA, 366 bp, Homo sapiens
  misc_feature 16: w=a or t
  misc_feature 17: r=a or g
  misc_feature 89: w=a or t
  misc_feature 109: r=a or g
  misc_feature 184: v=a or c or g
aagaacgggaacaggwraatctgtcaccatctgtgcatggtacagcaggtgtggattcaacacaggttatgctgatcaaattgtgtgtwtctactttagggctgttttrctgcagcttctgaagtgttaaagcacttgaaggaacgatttccgcctaatagtcagcacgcccaggtaatctgcvttttgcatggcaatagatttatttctgataaaaatagcttttattataatataaagtgggacataatctcccctcagaaaaataatattgagctaaaaaggaacttgtcaaaggatgcttacaagtatgatattatttatataaagtttaaaaacacaggctcatactctatgttgtttaga

SEQ ID NO: 33950 - DNA, 199 bp, Homo sapiens
  misc_feature 139: k=g or t
  misc_feature 147: k=g or t
  misc_feature 176: k=g or t
tgtctttgctgtgtataacctctttagtttaattaaattccatttgtcaatttttgttttagtcatgaagtccttgcccatgcctatgtcctgaatggtattgcctaggttttcttctagggtttttatggttttaggkctaacgtktaagtctttaatccatcttgaattaattkttgtataaggtgtaaggaaggga

SEQ ID NO: 33951 - DNA, 88 bp, Homo sapiens
tggctcccttacatggctggcaagttggtgcttgttagcaaaataccttagttccttgacaggtagatttctttctttctttctttct

SEQ ID NO: 33952 - DNA, 257 bp, Homo sapiens
  misc_feature 146: k=g or t
actggggacctgctggacctgctggacctgggtgcgacgagtgggcggccacgctggtttggcgcggggaaggaagggggtgtgccgacttgtatttagttgggggttgtggaagtcacggcctggggggaaaagcgtccggtggkttgttggtaaagaggggcaccactttcagataaaaacatagacctgaatggcatcatccagtatccaaggaaaccatgttctctaaacatgaatatgcctttgggggaact

SEQ ID NO: 33953 - DNA, 202 bp, Homo sapiens
  misc_feature 85: m=a or c
  misc_feature 91: k=g or t
  misc_feature 95: w=a or t
  misc_feature 97: m=a or c
  misc_feature 101: m=a or c
  misc_feature 104: m=a or c
  misc_feature 140: m=a or c
actaaaggaagtacttcaagctgaaatgaaacgctatggtaccagatggtaacttgaagaaaaagaagagcagaagttaatttcmggaggktaawtmtgamcgmcaataagtaaatgtttcttttattatcttgactgamttaaaggcatttgccagctgggcatggtgactcatctgtagtcgcagcacgttgggaggcaa

SEQ ID NO: 33954 - DNA, 143 bp, Homo sapiens
  misc_feature 93: k=g or t
tcaatatcccatcaaaagtacagttagagaatacctagtgaatttattgaatataatgctaagaatcaaaagacttgtactagtttaccttckggctttggtaagtgtggctttgagtaataactgagctgtttccccgcatt

SEQ ID NO: 33955 - DNA, 419 bp, Homo sapiens
  misc_feature 334: n=a, g, c or t
  misc_feature 386: n=a, g, c or t
  misc_feature 387: k=g or t
  misc_feature 388: n=a, g, c or t
aagtctcccactattattgtgtcagagtctaaatctctttgtaggtctctaagaacttgctttatgaatctaggtgctcctgtattgggtgcatgtatatttaggatagttagctcttcttgttgcattgatccctttaccattatataatggccttctttgtctcttttgatctttttgtaaacaactcgagataattggctgagaatggttggtgagacttccccggaggctcgtcagcatgggcaactgcaatgttgaatcttgttactctgatttccagcaagatggccgaatgggaacggctctggtctgcggctcccagcgagatcgntgcagaaggccagtgattctgcatttccaactcaggtaaaccgggtctgagnknacctctactgcttaagatctgttttatcaga

SEQ ID NO: 33956 - DNA, 277 bp, Homo sapiens
  misc_feature 219: n=a, g, c or t
aatcatttatactacttgccaataatgataatccttgtcaatgactatacttatatttcaaattaatgtcttattttattggcttaaacttccaaacaatgttaaataatagagaagacaaatactctttttaaaagaaaaaagtaaatatttctctccttcttacatacataggctggattctagtgacatttataacgaattgaaagaaacatatcntaattatcttcctctgtacgttgcacgacttcatcaattggatgctgaaaaggaacga

SEQ ID NO: 33957 - DNA, 369 bp, Homo sapiens
  misc_feature 12: s=g or c
  misc_feature 287: n=a, g, c or t
  misc_feature 338: y=c or t
  misc_feature 341: n=a, g, c or t
  misc_feature 348: k=g or t
atgtagcgtaasttgcaaccagagaatgcttaataaatgttaattgctgtctgactcctctgaatgtggtgtgtgaactgatacctttggatcctcatgcctcattctgtccctgagacttattctagatgtcacttcccctacttcacattatacacgaatgttctgaggacatttgagatggaatctagctcacattttcagcactagtttccaaggaacacaaagaagtccagtgacatgatccaggctctcagccttacagatcatcatgtagattaagtggncgaggctctttcctatgcagaaaccttcctacaaccaaggtaccccttgtyatnattgtcktcctgcaactttcataattga

SEQ ID NO: 33958 - DNA, 356 bp, Homo sapiens
acatatgagagagctgagctatataagtaatttatttacctgcattttactccaagccagtaatgctaggtctggtatttgtgtccagctttgactctaaagccccacatgttttcattttactaagttgtcataataaatgttctactactttttgtggattatacaagaagccacgtgagtgcagcattttattttttatttttatttttgagacggggtctctctctcactcccagactggagtgcggtgggagaacgtggctcactcagccttgaactcctgggctcaagggatcctcctgcctcagcctcccaagtagctggtactacaggcatgcaccaccatgcctggc

SEQ ID NO: 33959 - DNA, 244 bp, Homo sapiens
  misc_feature 131: d=a or g or t
  misc_feature 132: r=a or g
tgggaggaaaactccatttcctccttccctgccggtttctcccctctaccctggcaccccaaatttcgatgtgccgcctgccgggcgctaagcgccggtgttgagagaggcggcggccgccgcgcccgggdraatgctgggcatgtacgtgccggacaggttctccctgaagtcctcccgggttcaggacggcatggggctctacacggcccgcagagtgcgaaagggtgaaaagttcggaccc

SEQ ID NO: 33960 - DNA, 114 bp, Homo sapiens
cagaggaaaatgataaggatttaggcagggactgcgttggaaagggccttgcaacaggcctggacgttgtttgtaggcaagtaggggcaccgaaagctttaaagcagggagttt

SEQ ID NO: 33961 - DNA, 86 bp, Homo sapiens
  misc_feature 14: k=g or t
  misc_feature 71: s=g or c
  misc_feature 76: m=a or c
cttagtgccagttkaatccagttatgcagaagaaattcatattggttgcctgatgtagagctcagcaccascctamcacaggcctt

SEQ ID NO: 33962 - DNA, 380 bp, Homo sapiens
cacatgagatgggtctcttgaagacagcataccgatgggttttagtattttatctgacttgccattctgtgtcttttaattgaggcatttagcccatttgcatttaaggttagtattgttatatgtgaatttgattctgtcatcatgatgttagttggttattttgcagacttgtttatgtggttctttcatagtgtcactggtctttgtacttcagtgtgtttttatggtagctggtaatgtttttcctttcgatatttagtacttctttcaggagcttgtgaaaggcagggctggtggtgatgaattccctcagcattagcttgtctgaaaatgatctcatttctccttcacttaggaagcttagttcggctggctac

SEQ ID NO: 33963 - DNA, 110 bp, Homo sapiens
  misc_feature 84: r=a or g
  misc_feature 96: v=a or c or g
taaagtgtaaattcagtggcttttagtatattcacaaagttcaaccattattacatcaatcttagaacattttcataaccttgraaagaagcctcvattcatacccatat

SEQ ID NO: 33964 - DNA, 359 bp, Homo sapiens
  misc_feature 84: r=a or g
  misc_feature 86: r=a or g
  misc_feature 92: m=a or c
catttggggcaccactgaagagttttagagagaggtgtggtgtgatcagatttgtagtaggttggtttctctgctatctccagrgratagamctggaggggccaactaaagacagaaagccagatactgagttttatgagattatgtttgttatagtttgaaatgacagcctttgagatacgtgcatttgacccaagagtcttgtaaatgaagtgaaaatactactgagcacaagagctctgggttctattcttaccagtttatcattatatcatctaacatcttcagattacaagtctcttaaggtataaaaggaattcaataatacctgcttgcctctccctacttcacaatagatt

SEQ ID NO: 33965 - DNA, 269 bp, Homo sapiens
  misc_feature 90: w=a or t
  misc_feature 100: m=a or c
  misc_feature 144: v=a or c or g
cgcttgtaatcccagctcctcgggaggctgaggcaggaggtttgcttgaacctgggaggcggaggttgcagtgagccgagattgtaccawttgcaactcmagccctgggcgacaagagcaaaactctgtctcaaaaaaaaagavagaaagaaaatgtaaataattggccaggtacggtggctcacggctgtaatcccaggactttgggaggccgaggcgggcggactacgaggtcagcagattgagaccatcctggctaacacagtgaa

SEQ ID NO: 33966 - DNA, 339 bp, Homo sapiens
  misc_feature 95: h=a or c or t
atccctggtagggggcatgttccccaatctcaagaaccccatcgccccaccataggcaactccaccagcctctcactcaccaaagtaatcagcchttcgggtgagcatccatctctcgctccagacgttgggtgagggcttctaatttcaactcagcagcagagggtctcagctcaggacctgggacgaggggctggcagggcagccttaccctaggggagctggggctgtccaggagcacagatcccaggctaccatcagaagaccagcccaggggacctctttacaagataactcaggcagggtggacatcactggatggacaagactggtggggct

SEQ ID NO: 33967 - DNA, 265 bp, Homo sapiens
aatatgtgaaagcttcttgggccattattcttttcatctcagccaatagcctctgtccttgctccttgacatacttcttgatgactggtagtggaccagcaaagtagttaacctgtcccaaaatcacacacgaagagaggctagtgtttacagaatttcagccagcgagcctggtgcagtggcgtatgcttcttgtcccagctgcttagaaggctgaggtgggagaatcacttgagcccaggagttcagatgtagcaccggaagc

SEQ ID NO: 33968 - DNA, 251 bp, Homo sapiens
  misc_feature 83: r=a or g
tggattatttgttaacacatttggtggcaaagcacccaataataaagatagctgtgactgggcatggtggcttatgcttgtgrtcccagcactttgggaagaccgaggcaggaggacaccttgagcccaggagtcaagattgcaatgagctgtgattacactactgcactccagcctggtaacggagtgagaccctgtctctttatttaaataaagaaggaaatattcctttaaaatttatttttcctttt

SEQ ID NO: 33969 - DNA, 143 bp, Homo sapiens
  misc_feature 103: m=a or c
  misc_feature 105: r=a or g
  misc_feature 114: k=g or t
  misc_feature 116: b=c or g or t
  misc_feature 120: r=a or g
caataataaatttggctttggcaaaatagtacaaatataatatgataaaagggatggaccaaggaggcttaagcttgaggatgcaaagtcacgtgtccttaamcrgctattttkcbagtrtactctgttagaaagggaaccaa

SEQ ID NO: 33970 - DNA, 155 bp, Homo sapiens
aaaatgttatctcagtgtctattcagattttaacatatagattaattctttttttctttatttttccacactatacagatgtatagactaattctttttaggaatgtatttttgccatttccctcattctgtcactttattaaatagtaatttaa

SEQ ID NO: 33971 - DNA, 191 bp, Homo sapiens
cctcagcctcccaaaaagctgggatagccagcatgtgccaccatgcccagctaatttttgtatttttagtagagacggggtttcaccatgttggcaggctggtctcgaactcctgacctcagatgatcgatctgccttggcctcccaaagttctcggattacaggcattagtcatcctgccccccccgcgc

SEQ ID NO: 33972 - DNA, 247 bp, Homo sapiens
ttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcatctcaaaaaaaaaaaaaaaaaa

SEQ ID NO: 33973 - DNA, 216 bp, Homo sapiens
caccttccctgtcttcccagcacctgaatactgtgccctacttatgcccaaaagacaatgtacttcttgaggaatttttgtaatttagaagcatgtttttgctacctacaggattaaaaaaataaaaataataaagatgctgtcagacttggcctccaggcaatttagtgctgcctgtggcttctggtactgtgcattttaaacagtcctgccagt

SEQ ID NO: 33974 - DNA, 151 bp, Homo sapiens
ccaccacacccggctaatttttgtatttttagtagagacggggtttcactatgttggccaagatggtcttgatctcctgaccttgtgatccgcccgcctcggcctcccaaactgctaggattactggcctgagccaccgtgcccgcccggc

SEQ ID NO: 33975 - DNA, 158 bp, Homo sapiens
  misc_feature 91: r=a or g
taattttaggtattttgagtttgaggatttttttatatttaagcgaaaataagtagtagagagatgtaatgggtctggtgttcaatggagragtattgactggagatataagtttgggagtcagttgctgggtagctgataattgaaatcaagcgcac

SEQ ID NO: 33976 - DNA, 109 bp, Homo sapiens
  misc_feature 89: r=a or g
  misc_feature 96: r=a or g
taaagtgtaaattcagtggcttttagtatattcacaaagttcaaccattattacatcaatcttagaacattttcataaccttgaaaagragcctcrttcatacccatat

SEQ ID NO: 33977 - DNA, 317 bp, Homo sapiens
  misc_feature 142: n=a, g, c or t
  misc_feature 173: y=c or t
  misc_feature 174: w=a or t
  misc_feature 189: n=a, g, c or t
  misc_feature 190: k=g or t
tctcactctgtcgcccagaatagagtgcagtggtgcaatctcagctcactgcaacctccacctcccaggttcaagcgattctcttgcctcagcctcccaagtagctgggactacaggcgcctgccaccatgcccagctaatntttgtatttttagtagagatggggtttcacywtgttggctagcctgnkctcaaactcctgacctcaggtgatctgccctccttggcctctcaaagtgctggaattacaggcatgagccaccgcgctcggcctccatgtcgcgtaatctcttgaacttgttccctcctatctaact

SEQ ID NO: 33978 - DNA, 111 bp, Homo sapiens
  misc_feature 56: w=a or t
  misc_feature 62: w=a or t
  misc_feature 64: r=a or g
  misc_feature 86: y=c or t
  misc_feature 94: k=g or t
tttctcttagatatataactaggagtggaattgccgggttgaattttttttttttwatgggwaracttttctttttgagacagggycttcctckgtcacccaggctggagt

SEQ ID NO: 33979 - DNA, 130 bp, Homo sapiens
atccatgtgttactttggcgccaagtagccatatccaaaccaaactcaaatcttcacccatgccaaaacattccttggcctatctaaagtccctttgattcctctctttcttacaccttcatgcagtccc

SEQ ID NO: 33980 - DNA, 159 bp, Homo sapiens
aggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgccac

SEQ ID NO: 33981 - DNA, 192 bp, Homo sapiens
  misc_feature 149: k=g or t
ttcgtttgtctacattcctttctttgtgctattgtcatatcttgtgcatctacttataccgtaaatcccgtcttaggatttgtgttacttgctttaaatagttagttgccttttaaggaaattacattggaggaaatattttcttagtkatttaccttatgatgttctttcctagaaatctaagtttccatc

SEQ ID NO: 33982 - DNA, 316 bp, Homo sapiens
  misc_feature 284: n=a, g, c or t
  misc_feature 285: s=g or c
tgcaaccgttttgaggagtttagtaggggcctaagaccaaaaagtttcagagctacttttctaaaacagtgccactcaaaggctgcagcttcaacagcctttaggcttgttagaaatgcagattcttggccaggtacggtggctcacacctgtaatcccagcactttgggaggccaaggctggcggatcatgtgaggttgggagttctagaccatgctggctaacatggtgaaacctgtctctactaaaaatacaaaaaattagctgggcgtggtggcatgcanstgcagtcccagctacttgggagactgaggca

SEQ ID NO: 33983 - DNA, 158 bp, Homo sapiens
caattttggcttttgttgccattgcttttggtgctttggacatgaagtccttgcccatacctatgtcctgaatggtattgcctgggttttcttctagggtttttatggttttaggtctaacatttaagaagaaggatacttaaagtataagggaaatg

SEQ ID NO: 33984 - DNA, 75 bp, Homo sapiens
ctttcattaactgtgatttggggcatgttttttaactattgggtgccttggtttgctcttcagtatgattgggat

SEQ ID NO: 33985 - DNA, 377 bp, Homo sapiens
cctgggaaaatcatttttatagagatggccttccaagtggttttaaaatttactgaagtttttaggtcaattatgtatgttgactaaatttacaaataaacttgtttatccaactaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgt

SEQ ID NO: 33986 - DNA, 266 bp, Homo sapiens
  misc_feature 210: b=c or g or t
  misc_feature 240: b=c or g or t
gtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcbtcacgcatttgtatatctccagaaattcabgtatgcctcaccaatttgcccgtctt

SEQ ID NO: 33987 - DNA, 396 bp, Homo sapiens
  misc_feature 357: m=a or c
  misc_feature 358: n=a, g, c or t
  misc_feature 359: n=a, g, c or t
ccctcagtgggaaatacccttcccgcagatctcctcagactctcgccctcgtgccattcgagtcaacttcaggccttccctgaccatctaacatagcatcccctgttactctccctcacttctgtgttttccttcattgcatttacctctccttaataggatactgtagctttccttatgatctttctcccccattcgaatgtaagccctaggagggcaaggtccccagcacctcacacagtgcctggcacacagtaaatatttactacaaatttgctgaataaggagcatgaggagctggcttgtctgatccgtggagttttgctgttcatctccttcaggctcgtgtgccctccmnnttgggtactcagggaggcaggacctggcaggagtcct

SEQ ID NO: 33988 - DNA, 123 bp, Homo sapiens
taacagaactaccatatgatgcagcagtccctttaccaggtatatattcaacgaaaatgaaatcagttatgttgaagaaatgcctgcacttacatattcattgcagcattatttacgatagca

SEQ ID NO: 33989 - DNA, 83 bp, Homo sapiens
caaactatttaatctgtctcactgttgttttcgtttggtgaatacatttcaaaaaggttataatgtataaagtttgtacaaac

SEQ ID NO: 33990 - DNA, 163 bp, Homo sapiens
  misc_feature 84: y=c or t
  misc_feature 87: k=g or t
  misc_feature 98: k=g or t
  misc_feature 100: s=g or c
ttttttttccttttattattatactttaagttttagggtacatgtacacattgtgcaggttagttacatatgtatacatgtgcyatkgctggtgtgckgsacccactgacttgtcatctagcattaggtatatctcccagtgctatccctcgcccctccccca

SEQ ID NO: 33991 - DNA, 157 bp, Homo sapiens
taacttcatttatcacacatgaaatgtaatatattttatgttgtttgatgaccatcagtctctcctcgtagactgtatgtcccatgaatacagtcgtcaggattggttttgttcagtgttgtgaacaataccattcctccattagtggaaccccgaa

SEQ ID NO: 33992 - DNA, 287 bp, Homo sapiens
tgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccccc

SEQ ID NO: 33993 - DNA, 194 bp, Homo sapiens
ttttctaaagcaacccgacctgggttttaaaatgcagcaaaatatgagatgggaggaagggggcttagtgcccaaagcagagccttaacaagcttcatgtctgtggaagagatcattgtcctatagggtggtgtgtgctccagcctgacccagaagtggactgcatgtaagagccttgacccagagcatccaga

SEQ ID NO: 33994 - DNA, 81 bp, Homo sapiens
tgttggccaggctgatctcgaactgctgacctcaggtgatccgcctgcctcagcctcccaaagtgctgggattatgggctc

SEQ ID NO: 33995 - DNA, 218 bp, Homo sapiens
  misc_feature 89: r=a or g
  misc_feature 99: r=a or g
  misc_feature 107: k=g or t
  misc_feature 114: k=g or t
cagaagtctttctcctgcccagagccagcctgtgggaagtctttcaactttaagaaacacctgaaggagcacatgaagctgcacagtgrcacccggggrctacatckgtgagtkctgcgcccggtctttccgcactagcagcaaccttgtcatccacagacgtatccacactggagaaaaacccctgcagtgtgagatatgcgggtttacctgccacc

SEQ ID NO: 33996 - DNA, 173 bp, Homo sapiens
aagagccttggaacatctctctgaagaataaaacaaatcttttctgcatgtataatcgatataaatttgattatattgtactttttatttcgtgtgtgtgtgtacatgagattacatgtacattccctttctcccttttcctttgcttgtctcccttttctgtcccccccgct

SEQ ID NO: 33997 - DNA, 308 bp, Homo sapiens
acatgggccccattaccacttctccaaaatggtggcattgccccctaggctttctagcctcgtagtctgctcctcacagctgacccagtctctgtgtcccaagtgctaatacccagaagagaggatcctaatggcccaggttgggtcagatgtcgttctctaagcaggctaaagatgtgatgtgacagatgctttgagaaaaaacaaaatagtagtaaagaatgggtaactctaatatattttaaacgtttctggacttcatgttaacccagtgtattggttgtctatgactatataacaaggccccc

SEQ ID NO: 33998 - DNA, 411 bp, Homo sapiens
tatgacagtgacctccctcagcctctcccaggcacacagttttaccccttctcctaaagcaggttcgcacgcccatctaaaggcaacttcagtatttgcttttacttctctttaaagattacagccttaaaaatattcagtaaaatattgtacttccataaagcattgcccctgagtaagattagtgcttctcagtggacacagcagcagggaactttgtgcgttcatgctgagctggtggctgtgtgatgctattgaaaagggaatacaccaccatcagcgctcggttaaaacgtcttctccctgaaatttaagaaagtcacaggctgggcgcggtggctcacacctgtaatcccagcactttgggaggccaaggtgggcggatcacctgaggtccggagttcgagagca

SEQ ID NO: 33999 - DNA, 235 bp, Homo sapiens
tttatggtagagagatatatttgtattggttccagttccattggtttgtgaaatattaatatgccaacacagcctagcatattggagtcactggaaatgcatcagtgctagccttacatgcctttcactctatggtgttaacctgcctttttctaagtctaatctccacttaccccagctgtatcacactttttctttccaaaattcctaatcctctgtcttcactcccctcact

SEQ ID NO: 34000 - DNA, 179 bp, Homo sapiens
gattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaa

SEQ ID NO: 34001 - DNA, 211 bp, Homo sapiens
tttagctctttatttgtacgttttttcttcagcttggattttcagtgttgatgctgcatgttataggctgtgaagtttgacagtacccaaaagagaatgaaagtggaaatgagaggaatttggtaacacggtgtttttaatgtgaactttttgtttaaagcaaatgcagccctgaggatttggctactgcatataacaacagggggcttcg

SEQ ID NO: 34002 - DNA, 213 bp, Homo sapiens
agtgaatattgatatattattattaactaattttatagtttactttgtgttatgtattctatggactttaacatgtgtaatgacatgtatcccctattaccagtatcatacaggatagtttcacttccctaaaaatctttgatgttctacccactccttcctcgttccctctcctcactcctccctccctccatcttaagcccatggcaacct

SEQ ID NO: 34003 - DNA, 173 bp, Homo sapiens
taataaactgatttcactgcacattcccgggttaagaacagcgatttgattttgctgtatctttaagtaacatgacaaaagagatctgttgggtctcattggtctaaaagcaaatttgttaataaataacaactgaaccttcagggaaaaaatgttatatatgtaccaggcgc

SEQ ID NO: 34004 - DNA, 90 bp, Homo sapiens
  misc_feature 11: k=g or t
  misc_feature 22: k=g or t
  misc_feature 71: s=g or c
  misc_feature 72: s=g or c
cgatgccttgkacatgattgcktatttgaactgattctgctgttgccctgcttgtcagctacagtcagtcsstcttgggctggcgggact

SEQ ID NO: 34005 - DNA, 187 bp, Homo sapiens
  misc_feature 95: w=a or t
acagacacatttacactagaggccagggatagaggatattgggtctcagccctaggggaatgggaagcagctcaagggaccctgggtgggagcawaggaggggtctggacatgtggttactagtacaggttttgccctgattaaaaaatctcccaaagccccaaattcctgttagccagctggaggc

SEQ ID NO: 34006 - DNA, 330 bp, Homo sapiens
gacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgactt

SEQ ID NO: 34007 - DNA, 333 bp, Homo sapiens
  misc_feature 125: w=a or t
  misc_feature 130: y=c or t
  misc_feature 134: r=a or g
  misc_feature 155: r=a or g
  misc_feature 169: r=a or g
  misc_feature 327: h=a or c or t
  misc_feature 328: n=a, g, c or t
catgtaaaggtccttggcagtgatacctaatttcctaagatagccttgctttatattgtgtgattaagatgtcatgcatatcagagtatctggaaattcttcccaacgtcctttacatacgtgawttaaycacratttccaaaataacataccaraacgaataacagaraatcattttaagttgtggttccttcatgcacaaaacatttcatgtgtgtctggccctcttccggccacagatttcatcttaacctaagtattgaaatgcttgtgccctttgattaatttttctgtgtaaatactttgataataagctacattgaggchnggtag

SEQ ID NO: 34008 - DNA, 167 bp, Homo sapiens
cattcacctaatttaattccttaaaataacttatctgtaatctttcccctacccaatgctccgtcaagtaaaatggattgctgtaggtcagtgggtttaaaggaccttatttggtttggacttttatttttttaaatttatttgtttattaatttcttttttttttt

SEQ ID NO: 34009 - DNA, 245 bp, Homo sapiens
  misc_feature 87: r=a or g
  misc_feature 89: v=a or c or g
  misc_feature 90: v=a or c or g
  misc_feature 92: m=a or c
  misc_feature 98: w=a or t
  misc_feature 105: k=g or t
  misc_feature 111: r=a or g
tctcaaatgcattgtaatttttgatggtcactaagccccatttctttccccatattctcatctgaactctaatgaggagatagaatrtvvgmcagttwaaaggcktaaagrccttgttctgaagtcgggctgacagggagtcaatccagatttccctctgggtgacctggagcaagttacttaacaatccatgcgtcggtcttcccatttgtaaactggagggaggaggggagggttggataata

SEQ ID NO: 34010 - DNA, 82 bp, Homo sapiens
tgacagtggcagtgatggtggtggtgatggtggtggtggtgatggtggcggtggtgatggtggtggtggtgatggtggcggt

SEQ ID NO: 34011 - DNA, 170 bp, Homo sapiens
  misc_feature 93: r=a or g
  misc_feature 98: v=a or c or g
  misc_feature 112: r=a or g
  misc_feature 113: k=g or t
  misc_feature 150: r=a or g
tgggattcttgacttagagatatagtgtatagacttttgtggtatttttaatagtgagattcaggggacccaaatctgggtggttgcaaaggraatgvaaaaagtatatatrkaagcagtggttatataagagacagggtgaaagaatarctaaataaatctggaccaat

SEQ ID NO: 34012 - DNA, 81 bp, Homo sapiens
tcattcaagatttaagatgttgcaacacaacaatgttaactttttttcctagatggaactttatgattttttttttttttt

SEQ ID NO: 34013 - DNA, 243 bp, Homo sapiens
gatatgggccttgtgtcagttccatattttactctttccaagccccttaattggtgggagcttgtaaatacatattcagcatctggtaagtgaattatggaaataatctgtaaatcttaatccaagttacaatattaagaaaattttaatttcatttccccttgcaagcaaagatattaagccatagattagatgtggggaccttacattttatactacacttgtaagtacttaatggcacca

SEQ ID NO: 34014 - DNA, 214 bp, Homo sapiens
aaattaaaaagaaaataaaaaagttcaacttataaaggtaaacactgatacatttgactatgttaaaatttaaaacttctagttaacaaaaggtaccatagaaaaagtgaaaaggtagacgacagactgggagaaaagatttttcatcaaaaataattgactactggctgggtgcggtggctcacgcctgtgatcccagcactttgggaggccc

SEQ ID NO: 34015 - DNA, 235 bp, Homo sapiens
  misc_feature 15: m=a or c
  misc_feature 16: m=a or c
  misc_feature 90: s=g or c
  misc_feature 96: s=g or c
  misc_feature 105: n=a, g, c or t
  misc_feature 109: r=a or g
  misc_feature 110: r=a or g
  misc_feature 124: m=a or c
  misc_feature 197: m=a or c
  misc_feature 225: r=a or g
attatataactttgmmtgaaaccaacagcacgctcattgcacatatcatgggctcatttatttcacttataaagaacctggccaaggaasagatasgtgcctaanagtrrgccagtattctgamcgatatgttagaaaaatggtgtgccgaccaattcatgacatgtgtcccaaaactagcaacggaaattgtattmgccgtgttgaggtctctaatccagatgrtgctcatcta

SEQ ID NO: 34016 - DNA, 277 bp, Homo sapiens
ccttttaaaatttgcatagaggccctccatgtgatagcagcagctctgtcagttatagctaagtttagctcccagcttctatctgttgccttgtcccatgtcatttcttgtccctcactgatgattgatcaaccctgaagatgggcgagaaacttctcagttccccaaaccaacctcattttagtctggacttctgggaaatagaatcagccctggcccagtctctgtgagtctaatgctctgctctctagccttccccagacactcccccctccac

SEQ ID NO: 34017 - DNA, 322 bp, Homo sapiens
  misc_feature 270: n=a, g, c or t
tacgtccatactcctcatttgagaaaatgtgacctgtgcttggcccgtgcagtagcccaccaacggagcatgtgcaggggtcctcagggcctctgtgtcaggactgtggcctacagcctacagctgcagtcacctcgcatagacagaggctttgtgatcgtgtaggttctggaactatccccaaactgatcctgtgatcacttgacatgataaagaatcctcccacatttttctgtgaagagaagccgatgttgtagtgctaaaacgtgnccattctggtcctgtatttgtatcattttgaaagcaatgcaaagccctgtca

SEQ ID NO: 34018 - DNA, 151 bp, Homo sapiens
gtattagccagtttctcaagtgtattgttactagttttttcctcttgtaattattaagttgtgggtagttgttttgagtgtatccagatgactgttgtgaacactcttctcacacatagcttgaagcctgtattttttttttttttttttt

SEQ ID NO: 34019 - DNA, 248 bp, Homo sapiens
cattaccaagtcaatcctaagccaaaagaacaaaaccggaggcatcacgctacctgacttcaaactatactacaaggtacagtaaccaaaacagcatggtactggtaccaaaacagagatatagacccatggaacagaacagagccctcagaaataatgccgcattatctacaactatctgatcttagacaaacctgacaaaaacaagaaatggggaaaggattccctgtttaataaatggtgctgaa

SEQ ID NO: 34020 - DNA, 365 bp, Homo sapiens
tcacttgataaatatgtattgagtccttttgaggtgccaaactcacttctagggaccacaaatatataaatgactaagtgaaacccaattgcatatcctgcaggagcttagaatctactggtagaaacatacaattcaagagcaatgataatactctgtggtgtttctctggtgtagcacatggaagaggcacagtccatcccagggaaggctaaacaagaagcaggagttagcttggaatcacagggggaaagaagattttcagtgagaggaacaatgagcagcttatagaagaaagatgtagtagcagaacctggtgatattttgtctcttagaaattgctgtcatctgtgagagacagtgtc

SEQ ID NO: 34021 - DNA, 378 bp, Homo sapiens
tatgtattaaattgtaggaaatgttagataaacagctttctttagtattttttgagttagaaagcaagtttttagcttggggtcagaatatttttagagaaaaagtttaaaatgtgcctaaatctgaaattctggattaaaaaagtgaaaatctgcatgttcctctaatacctaatgacgaattctaattgcagaaggatgccaataactaaaaccacaaaatgaaccctatgtataccggtgaccttctttactcagaattaattaacacaagcacttgtttcttgcagagcactttgctgtaatttagaacaaattaagggaaaaaatcattcaagtgctgttttcttcacaccatgaagtaagcatgatggaccg

SEQ ID NO: 34022 - DNA, 229 bp, Homo sapiens
taaatttgaagatttatgcttattcgcaaatgggccctgagaatatctttggagctcagaaagttcacgcttgacttccttttcactgttctaagtaaacgagttcttaaatccccgcagtctccccgcctgggctctgggtctctgccattgcctcagcctgcattcatttggaccaacaggaactgagatgtgacttacctctgaggtgtagaggaggagggcgtca

SEQ ID NO: 34023 - DNA, 366 bp, Homo sapiens
  misc_feature 151: k=g or t
  misc_feature 218: y=c or t
  misc_feature 219: n=a, g, c or t
gtagaaagaaagtgttcaaacagagcttttactttttttttaagacagagtctccctctgtcgcccaggctggagtgcagtggcacaatgttggctcactgcaacctccacctcccgggttcaagcgattcttatgtctcagccacctaaktagctgggatacagacgtgcaccaccacacctagctaatttttgtattttcagtagagacaggataynaccatgttggccaggctggtctcaaactcctgacctccagtgatctgcccacctcagcctcccaaagtgctaggattacagacgtaagccaccgtgctcggccagagcttttacttttgcccctttaaaatagcagctctctttgaa

SEQ ID NO: 34024 - DNA, 139 bp, Homo sapiens
  misc_feature 98: r=a or g
  misc_feature 99: w=a or t
actattctctacggctgcattcctttcgctcttgccttcctttagaaccctggagaaggcctcctgaagcctggccctattatgtatcctgaccaagrwtaaacttttccaaaaagctgcatgttgtttctagcacaat

SEQ ID NO: 34025 - DNA, 346 bp, Homo sapiens
  misc_feature 245: m=a or c
ccacaatgccatttacacatgtaataagtataaaaattagtaaggtatttccttcctttttttcttaccaagtcttcaatatttagtgcatattttatacttatagcacttttcaatttagaccagccaccctttaattctttaaaatatttattgatttatttgttttcttcttctttttttctttgagacagggtctcgctctgttgcccaggccggagtgcagtggcacgatctaggctcamtgcaacctccacttcccaggctcaaacaattcttgtgcctcagcctcctgagtagctggaattgcgagcacccctgcttctcctctgcttgtacggctccc

SEQ ID NO: 34026 - DNA, 125 bp, Homo sapiens
ccaaagtgctgggattacaggcgtgaaccaccatgcctggcctcaaatttttctggggaaaaaaattattgataaataaaagttattgataagaataaaaacatttagactaaattatgccggcc

SEQ ID NO: 34027 - DNA, 192 bp, Homo sapiens
attcacatggatttcgaaaattactgagaggctaagaaactaaagttttccttgagaatgttcatataaattcaatgaactggtttatgttaatttgttatcttactatgtatgagagaagtgtaatggaaagagcctgcagataatgctttttggacatttaatttagtcacatttatttcattgctgcca

SEQ ID NO: 34028 - DNA, 131 bp, Homo sapiens
ctttaggttttagggtacatgtgcacattgtgcaggttagttacatatgtatacatgtgccatgctggtgcgctgcacccactaactcatcatctagcattaggtatatctcccaatgctatccctccccc

SEQ ID NO: 34029 - DNA, 158 bp, Homo sapiens
aagtgattcttgtgcctcaccttcccaagtagctgggattaccaacatgagccaccacgcctggctaatttttctatttttagtagagacagggtttcacagtgttggccaggctggtctcaaactcctgacctcaggtgatccacctacctcggcca

SEQ ID NO: 34030 - DNA, 133 bp, Homo sapiens
ttatctgtgacatgaggtaactgtattaaattttcagcatcaaatccagctataaatttgtattttgtaaacaagagaaagtaaagcaggagacagaatggagaagctggatagtgttttttttttttttttt

SEQ ID NO: 34031 - DNA, 59 bp, Homo sapiens
  misc_feature 4: v=a or c or g
  misc_feature 24: k=g or t
taavtttagccttgccgtattatktatagttaggaatttactacattttggtagtctgt

SEQ ID NO: 34032 - DNA, 185 bp, Homo sapiens
  misc_feature 87: m=a or c
gctcactgcaagctctgccttccaggttcaagcaattcttctgcctcagcctcccaagtagcagggactacagatgcgtgccacaamcagctaatttttgtatttttagtagacacgggatttcaccattttggccaggatggtctcgatctcctgacctcgtgatccacccgcctcagcctcct

SEQ ID NO: 34033 - DNA, 409 bp, Homo sapiens
  misc_feature 94: s=g or c
  misc_feature 367: r=a or g
  misc_feature 376: r=a or g
ttaatagagctagataaataatttgggggtatatatgggagattacttctgttagaagaggtagcattgagctgtattctaaatttagtaatasattggaattttcaggttggatgaagtaaggaagaggtactcagaattgaggcatgctcataggaatagcatcaggaagggtatgacaggtttgatgattattgagagtcaagatacacatttaagggaatggcaagagatgagaggttgagataatgctggggctcagattataaggagagttttgtgtatactaggcaactggtaacttacaatgatatggtacaatcagctttgtgttttaggaagttatctcagttgatgtcatgacagraaaatgggrcagagtgggaagaaattagaagcagaggccggc

SEQ ID NO: 34034 - DNA, 152 bp, Homo sapiens
  misc_feature 88: w=a or t
  misc_feature 89: w=a or t
  misc_feature 92: k=g or t
  misc_feature 95: r=a or g
cagagtaaaagagcaaaaaaatttcaacctcagagggtatggaaaaaaacagaaaaatacccttacttccagagctcctgattaaaawwatkgtragttgtgggttaagtttactgatttaaaaaaaacttagcatagagttgtatcactgc

SEQ ID NO: 34035 - DNA, 217 bp, Homo sapiens
tattaagtcaactcaggcctcagaatagtcagaatcatggtccataggcttgttaatcttaacttgcagtgtcaaataaacacacccatggaattgatctgacatttacaagatgtttacaggaaattataatgtcagtactaagaaaataagtaaatcagggttgaattgttttgactattgacacatattttttttgccaaactctccccatcac

SEQ ID NO: 34036 - DNA, 218 bp, Homo sapiens
agacttccagccatgtaaattgaacttaatgttttgctgaccataaatgtgtggccctagcaatggtcttttaaaactcaggatttttcctttctctctcctattattagacttattcgtctaatggaagagatcatgagtgagaaggagaataaaaccattgtttttgtggaaaccaaaagaagatgtgatgagcttaccagaaaaatgaggagaga

SEQ ID NO: 34037 - DNA, 148 bp, Homo sapiens
caatacctctcagaacggatatcctgtctttgtgctctgattctgaaagattattttctccttcccactgcctgcctcaacatcccctgcagcatattctgctggtactgctttctgacagataaaatctataacagcaaccagagct

SEQ ID NO: 34038 - DNA, 196 bp, Homo sapiens
ctcctgcctcagcttcccaagtagctgggattacaggcatgtgccaccacgcctggctaatttttgtatttttagtacggacagggtttcaccatgttggctggactggtcttgaactcctaacctcaagtgatccaccacttcagcctcccaaagtgctgaggttacaggcatgagccaccatgcccggcccgtc

SEQ ID NO: 34039 - DNA, 331 bp, Homo sapiens
  misc_feature 259: w=a or t
  misc_feature 316: m=a or c
caggaaaaagattgaataagagtatattatatgtgccaggcatggtggctcacacctgtaatcccagcactttgggaggctaaggcgggttggatgacttgaggtcagcagttcgagaccagcctggccaacatggtgaaaccctgtctctactaaaaatacaaaaattagccaggtgcggtggcgcatgcctgtagtcccagctactcgggaggctgaggcaggtgaattgcttgaacccaggaggtgagattgcggwgagctgagatcgtgccactgcgctccagcctgggtggcagatcaagactccatctcmacaacaacaacaaca

SEQ ID NO: 34040 - DNA, 92 bp, Homo sapiens
  misc_feature 92: k=g or t
ctctcttttggaatagtttcagtaggactggtcccaattctttaaatgtcaggtagaattgagctacgaatccaccttgtcctggacttttk

SEQ ID NO: 34041 - DNA, 212 bp, Homo sapiens
  misc_feature 5: m=a or c
  misc_feature 62: v=a or c or g
  misc_feature 64: s=g or c
  misc_feature 65: m=a or c
  misc_feature 88: r=a or g
  misc_feature 91: v=a or c or g
  misc_feature 92: r=a or g
  misc_feature 94: r=a or g
  misc_feature 99: k=g or t
  misc_feature 108: r=a or g
  misc_feature 120: r=a or g
  misc_feature 187: k=g or t
cctgmaagaacatatacctttattttgatgtggcttgaagcttttgaatgggtgaataaggvtsmtagaaaggtttcaaaatcaagcracvrargtctkaaagtgatraggcatggcttraagatcttttgatcaaacatacctgtgtttgagatagatttaagagccctaaatgcttatcaccatkcactccaaataaaactattgctttt

SEQ ID NO: 34042 - DNA, 156 bp, Homo sapiens
caaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggagccaca

SEQ ID NO: 34043 - DNA, 326 bp, Homo sapiens
  misc_feature 284: d=a or g or t
  misc_feature 285: w=a or t
acagtcacttgaagcttgaacctatgagtctcttttgtcattatttacacatatgaaagtattactgcagatcatcatatcatcactcagcatagttcagagtcagaagactaggaaaaggaatgttctttgcaggtcagggttttgatgactggcaaaacactaggcaagttgcactgcagttgtctgaaccacacccagactgcagttaaatatagaatttagtttctggaactgttagtcttaaccttcactgaaaaaattaaaagtaaagaggagaaagdwaagagactgaaaccaaagtctatgtactaataaactgtcct

SEQ ID NO: 34044 - DNA, 304 bp, Homo sapiens
  misc_feature 140: k=g or t
  misc_feature 141: k=g or t
tcatcccattcacaaagtgggatacaaaactgcccagcaactgtgtgtatttggtacaaaacagactacagctgctcattcccccctgtctagttaaaatgccaaattactcactctcccacagaaagaaaaaaaggagkkgtggaagaaaccatttctcactgcagagtttttccatgtgacatattttctaattttatttcaggtctaactgtctgcagtagatggctccatttcagggtcttcccctccccttttagtatatgagctttcattaaggaatgaagtggctttatttgtttaa

SEQ ID NO: 34045 - DNA, 230 bp, Homo sapiens
tgcaaaacatatgtccaacaaaggactttagaatataaggaattcttagctcagtaccaagtaccaagtattcagtaccaagaagacaaacaccaccataaaaatgggcaaaatatttgaacagacactaaaccatggaagacatatgggtagtgaagaagcacatgaagagatgctcaatgttatcagacaggagatatcactatacctccactagaatggattttttt

SEQ ID NO: 34046 - DNA, 159 bp, Homo sapiens
  misc_feature 23: k=g or t
tttattttattttattttatttkattttatttgattttattttatttttgagacagaatctcaccctgtcaccaggctggagtgtagtggcacaatctctgctcactgtaacctccacctcccgggttcaagtgattctcctgcctcagcttcccgagc

SEQ ID NO: 34047 - DNA, 145 bp, Homo sapiens
atacagagggtggtaacatccttaaaatgtatacatatataatattttctgacaagcatctggcattgtcatttgtgtcagattgtcatcattagatattttatttggaattgtttgtatgaaaaccaatcttcggcggggcttc

SEQ ID NO: 34048 - DNA, 62 bp, Homo sapiens
actacaggctcccgccatcacgcccagctaattttttgtatttttttttttttttttttttt

SEQ ID NO: 34049 - DNA, 369 bp, Homo sapiens
  misc_feature 101: w=a or t
  misc_feature 104: w=a or t
gtttagttacttcacctcttcaccaacaattggtattgttaatcttttgtaattttagcaattctagtgagtgtgcaatagtatttgattttgcttttaawttwacatttagctaataacttattacattaaatgttttgtgcttatcagacatttatctttgtaaacagtgcaaatctttcccccatttttactgtgttgtctgtttacaattgattcgtatgacatctttatatatgctgggtacaactgctttgtcaaagatatatagtgtgaatattttctcccatagcttagctttttcattctcttagtgtttttgtttgtttgtttaattctgaagagcacaggttttccttgttttgtttt

SEQ ID NO: 34050 - DNA, 123 bp, Homo sapiens
agtagctaggattacaggcatgcaccaccatgcccggctaattttttttgtatttttactagagacagcgtttcaccatattggccaggctggtctggagctcctgattttgtggtccgcccc

SEQ ID NO: 34051 - DNA, 272 bp, Homo sapiens
  misc_feature 94: m=a or c
  misc_feature 234: d=a or g or t
caaattcttgctattaaatgttgacatttgaaaggaaataattatccagggatgttcattttaaatgaaaattataactttacatttgtataamcatcttaagagctattaccctccagtttttctagaaatatgtggattgtatgattctttgagaaatagaaggaagtcagctctgctacagaaatagaaagtttttgcatggcgtgagtttagacagtcactttcttttadgtttcctggtacctctcatttcattttgaaacctaggc

SEQ ID NO: 34052 - DNA, 351 bp, Homo sapiens
  misc_feature 95: k=g or t
cagtgctttttccttttcatctgttgttctgtggtcacagtgaccttagctacatagcagactttcccaaatgtattgattacaaataaacagtkgttacttagcaagacctgaaaatatgtctgcaggtttctccttgaagcaaatgtgtgggatcattgcatttccagaaatctgcctccttcacccgtctagggcactggagcaaagaaaaagttattaaaggagactcaaaccactgacaagttacttgcggcataagtagtagtttttttgtttgtttgttttgagatggagtctcgctctgtcacccaggctggagtgcagtggcttgatctcagctcactgcat

SEQ ID NO: 34053 - DNA, 158 bp, Homo sapiens
  misc_feature 92: r=a or g
ttctgtcttagtgcagtagtattggaagcaaattctaaataatggagagaagtgtagtgaagcagaaagggcactgtattgggagtttggarggcttaatagtaacctggcatggggcaaattaggctctctctttgattttttttcttttttttttt

SEQ ID NO: 34054 - DNA, 290 bp, Homo sapiens
  misc_feature 95: w=a or t
cctaatttgatgtatgtggctgacagttgggaaactgatttcatgtgaaagtgcactgtttgtacaatacttatgcatgtcgtgttgttaaaatwaaccacttatgtgccttagatgatgagtttactaattacatatggaaaccttttgagttttcacttgtaagatttttaatgggaacaaagattttgatgcaccatagcagcccctcacctctctctctgctcctgcatgtgtgacatttctgacactggtgaggaagttcactttccattgcttttacatcctct

SEQ ID NO: 34055 - DNA, 349 bp, Homo sapiens
gtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacat

SEQ ID NO: 34056 - DNA, 287 bp, Homo sapiens
  misc_feature 237: k=g or t
  misc_feature 240: b=c or g or t
  misc_feature 243: w=a or t
  misc_feature 249: k=g or t
  misc_feature 270: k=g or t
tacagttttaagttttacatttaagtctttaacccattttgagttgatttttctatatggtgtaagaagggggtccagtttcagtcttctgtgtatggctagccagttatctcagcaccatttattcaataggaagttgtttccccattgcttgtttttgtcgattttgttgaatatcagatggttgtaagtgtgtggcattatttctgggctctagattctgttctctttttctakgtbccwattttkgtatgcacaccatgctgtttkggttactgtagcctcgc

SEQ ID NO: 34057 - DNA, 151 bp, Homo sapiens
tgacttttccataggaaaccagaaggaagagggagaaactcagattagctgatctgagatatttaggattcttctcctttgtgcttctgtgtatcttagtgttaagctaactcaacactaagctttctgaagccttgggaatcactgggcc

SEQ ID NO: 34058 - DNA, 85 bp, Homo sapiens
  misc_feature 65: y=c or t
  misc_feature 66: n=a, g, c or t
  misc_feature 67: k=g or t
cataagcacacaggggcctcgagggagctctgtgtctgaccgcacagcagcctctgaatgccgcynkaagtgatgatcatgtaaa

SEQ ID NO: 34059 - DNA, 103 bp, Homo sapiens
  misc_feature 62: w=a or t
ctctcttttggaatagtttcagtaggactggtcccaattctttaaatgtcaggtagaattgwgctacgaatccaccttgtcctggactttttttgttggcagt

SEQ ID NO: 34060 - DNA, 234 bp, Homo sapiens
  misc_feature 11: y=c or t
  misc_feature 18: y=c or t
  misc_feature 78: k=g or t
  misc_feature 95: k=g or t
  misc_feature 126: w=a or t
  misc_feature 135: k=g or t
  misc_feature 154: y=c or t
  misc_feature 162: w=a or t
  misc_feature 172: k=g or t
  misc_feature 188: y=c or t
  misc_feature 193: y=c or t
  misc_feature 201: y=c or t
  misc_feature 202: y=c or t
  misc_feature 221: w=a or t
  misc_feature 227: y=c or t
ttagtagagaygggattycaccatgttggccaggctggtctcgaactcctgacccaggtgatctgcccgccttggcckcccaaagtgctgggatkacaggcttgagccaccacgcctaacctcatwtgcatttckaacaagctctctccctggygatgctcwtgctgctgckttggggaccacatttyaagtyaatgtacyytagtgcacgaatgtttccwcatctyggagctg

SEQ ID NO: 34061 - DNA, 236 bp, Homo sapiens
  misc_feature 118: w=a or t
  misc_feature 124: r=a or g
cagatgctgttaccaaggccagcaagtgcagatggggtactaattctctcacttcggaggaggatgactctggtttatgtagccctccagcagagagggaagaaaaacagggcatttwaactgragaccagtcacgaattaaaagtttgtcttctgctgaagatattcttgtaacagaccaatacagaccatttttttctgttaattccattagcgaacagaaaatcccactgtca

SEQ ID NO: 34062 - DNA, 396 bp, Homo sapiens
  misc_feature 117: w=a or t
  misc_feature 353: r=a or g
  misc_feature 354: n=a, g, c or t
  misc_feature 355: k=g or t
  misc_feature 356: d=a or g or t
attaactgagattgtactgaagagttttgctaggtctataattattttcgtcagtttcttagccttcagaatgtttgtgaaggagatgtactaaaatcaaaagtgaataacttccawtcttcaccattgtgaagcaggatcagactttttttagttcacagtacctggacttttaggttaattgtatcatattttgaagatttcttgtttttcttgtggtgaaactttttcttgtgagaaactaaccctaccttttactttcacttctccgaatgcatgtcttataaattatagatagggcctgtggacctgcctcattatttcccttttgaagtaaggataactgcagtagrnkdcattttagatcttggaatttgctgcctttaccaccctcta

SEQ ID NO: 34063 - DNA, 266 bp, Homo sapiens
tatttgtgaagtgagtttatgagcaaggtctccagttgcattcttttcattaactcatgggcttaatttatcttgtttttttatctaccattttgtcaaaactgcctttgtcaaggtcctcaccattaccattaaccaaattcattgagtagttgtcatgtcttctaatattttaatttgaccagtatttacacagctgaaaattaacaattccttgaaataacttgaaattacaccttgtttggagtgaagtcattcctgttttt

SEQ ID NO: 34064 - DNA, 311 bp, Homo sapiens
  misc_feature 123: r=a or g
  misc_feature 126: k=g or t
  misc_feature 137: k=g or t
  misc_feature 230: n=a, g, c or t
aaaaaggagtagctattagccaattcggcagggcccgctttttagaagcttgatttcctttgaagatgaaagactagcggaagctctgcctctttccccagtgggcgagggaactcggggcgratkggcctggaackgtatccacccaaatgtcaccgatttcttcctatgcaggaaatgagcagacccatcaataagaaatttctcagcctggccgaaaatggttggcnccacgaagccacgacaactggaggcaaagagggttgctcaacgccccgcctcattggaaaaccaaatcagatctgggacgt

SEQ ID NO: 34065 - DNA, 282 bp, Homo sapiens
  misc_feature 130: k=g or t
  misc_feature 138: b=c or g or t
ctgtaaaggattttatttctccttcacttatgaagctttgtttggctggatatgaaatactgggttgaaaattcttttcttttctttttttttaaatctttttattttttttaatttttttaatttttaktttatatbattttactttaagttttagggtacatgttcacaatgtgcaggttagttacatatgtatacatgtgccatgctggtgcgctgcatccactaactcgtcatctagcattaggtatatcccccaatgctaaccctcccccctcccaa

SEQ ID NO: 34066 - DNA, 105 bp, Homo sapiens
  misc_feature 58: r=a or g
ctgattctttccatgcattagcatggaatgcttttctatttgtttgggtcatatctgrtttctttgagcagtgttttgtaattctcatggtagaggtctttattc

SEQ ID NO: 34067 - DNA, 363 bp, Homo sapiens
  misc_feature 140: k=g or t
  misc_feature 250: n=a, g, c or t
  misc_feature 318: k=g or t
  misc_feature 319: k=g or t
cataattcatctgctgtttggtgagcacgaagctgttttcacagtttcagcagcacagtgaagaataactttattcttctatatacaactttataatgtacataataacatatatatgtaaaataaattaactgtattckatatatacccctttttgcagatgtattctaacagaaggatttataggtgaaaagttatgttttttgctttattttgccaaaaggcacttaagaaagcctgtccaaatctngattctcagcagcagaatatgaaagtttctgactcctcacacccatgccaacaggctgagcattatckktattaatcttaaaggaagaaaacaagtgaatgggacatagcatt

SEQ ID NO: 34068 - DNA, 86 bp, Homo sapiens
ttttatgccagataccgtactgtttcctatacattatctcattcagtcttcgtaacagtgccttgaggtcatgttcccccccacct

SEQ ID NO: 34069 - DNA, 233 bp, Homo sapiens
  misc_feature 16: w=a or t
  misc_feature 17: r=a or g
  misc_feature 133: w=a or t
  misc_feature 134: w=a or t
  misc_feature 146: h=a or c or t
atactgtttgtggaawrtgtttaaaggattgattctagaacctttgtatatttgatagtatttctaactttcatttctttactgtttgcagttaatgttcatgttctgctatgcaatcgtttatatgcacgtwwtctttaatttthttagattttcctggatgtatagtttaaacaacaaaaagtctatttaaaactgtagcagtagtttacagttctagcaaagaggaaatt

SEQ ID NO: 34070 - DNA, 166 bp, Homo sapiens
ttactgaatgaacagtgtctgtcttgggtcttgtctaggaaaacggaataagaagcaggattcttgaagtctcaccttgagaatcatgctccaccccgctagaactttaccctgactcctggtccctgtgccctactgcctcacatttttcaacttctcctgctct

SEQ ID NO: 34071 - DNA, 285 bp, Homo sapiens
  misc_feature 132: k=g or t
catgtgctgtagtagttacatttcgttctttgtgtttagggtttttaaaattcagaatacctattactgttaaaaatttgcccagaaaaaaaatgttttaaagacattcaaaattagcccaatctctatatkaatccacagtcgagtaaaagaaagatctgcccaagatcgtttttctgagcttggatttgtttggttgaatggagggctagggagtcattggtttccatttcaggtaatattaaagccgatttagctattttcaaagcaaacgagataagacac

SEQ ID NO: 34072 - DNA, 218 bp, Homo sapiens
  misc_feature 153: s=g or c
  misc_feature 154: s=g or c
gagtttctctcatactaggtgatttacaagacgaaaatattggagaattttgtaactttcatacaactaaatcagatgcattgggtggccagaggcgagaagagaaggtccccaccgcccacggccagcgcgcacccgtctgcgcggggacgssgactgatgggagagtaggggatggagtcggttggcttttgcctacagccagctcagcgccccat

SEQ ID NO: 34073 - DNA, 151 bp, Homo sapiens
  misc_feature 102: y=c or t
  misc_feature 114: y=c or t
  misc_feature 135: w=a or t
tttatttccatgatagcatcattccagccagacttgctgaaaatctactggtgaggcaaatataatatatataaatatgctacatatatatttataaaattyctagtgggagtyctatataaatgtttctttggwattcttcagcctgtga

SEQ ID NO: 34074 - DNA, 197 bp, Homo sapiens
aaaagaaaaagctttgtaaattttctctaccttaggagtatttcatattgacaatgccagatttatcttgttttcataccttcctctaagcaagtggaaaagtggttaaatgtttaggtttcaaaaggtttgagtctgtgacaagcaagtggaatttatatggaagtaagctgtatatcaataattaaagggacaaa

SEQ ID NO: 34075 - DNA, 273 bp, Homo sapiens
tgcccaggctggagtgcaatggcacgatctccactcactgcaacttccgcctcccgggttcaagcgattctcctgcctcagcctcctgagtaactgggattacaggtgcccgccaacaatgcccagttaattttttgtatttttaggagagacaaggtttcactatgttggccatactggtctcgaactcctgacctcaggcgatccacccaccccagcactttgggaggccgaggtgggtggatcgcctgaggtcaggagttcgagaccagt

SEQ ID NO: 34076 - DNA, 304 bp, Homo sapiens
  misc_feature 121: m=a or c
  misc_feature 270: y=c or t
ctccactgctgaactggtccctaactgaaacagcccctgacttatcccaagcatgcttcctttagctgctgtgagaatttgtcttcctcaccagccaggtcctcaggcaaagtcctcagcmagtgctttagagcaacttcccgcaaatcagaaactcactgtgattccaaaaatgtttctgagccctggacccctgcccccaaaatattttcatctttcccccaaacctcctttaaaggagcatgcataacagtgtgctgaaagacagtygttggttttttgattttagcatattatttcctgt

SEQ ID NO: 34077 - DNA, 228 bp, Homo sapiens
ttactatggggccatttatatagcatacaatttatctaaaaacagcttgtttctttaatgcaacccaatagaatagtttagaagctgactaaaaataaattcaatgagtcaactagagagtaatcaccataaatttgaagataatgtaggaaagctaatagccaagacatggtatactctcaattgactagatcataagtaaaattatagtaatggacccccctcgac

SEQ ID NO: 34078 - DNA, 214 bp, Homo sapiens
aagccaagagttattggcgcttgctcggcatttgtggaccgaacaggcaagttcaaccgagcacgctgcccccgcgctccacctctgagttccctgggccactgcgacatggagaaaccccgttcttttcatcctctgctacggagaagggacgaggacacgggtcctgcagtgttggtgtggcgaggcccggaagaagagagaatgggcggcg

SEQ ID NO: 34079 - DNA, 156 bp, Homo sapiens
ttgttcttaacacagagtgcatttataaattattgtaagcttagttatttccctttcttgtggattttggtgtaatttacaggcagccaaaataagaattgtccttgctcatagtacaaccctttaattgacttgtgcctgagttttggtgtgagc

SEQ ID NO: 34080 - DNA, 92 bp, Homo sapiens
  misc_feature 1: s=g or c
  misc_feature 2: n=a, g, c or t
  misc_feature 16: k=g or t
  misc_feature 78: m=a or c
sntttctcgttcccckgccatcttagcggctgctgttggttgggggccgtcccgctcctaaggcaggaagatggtggmcgcaaagaagacga

SEQ ID NO: 34081 - DNA, 82 bp, Homo sapiens
  misc_feature 18: y=c or t
  misc_feature 20: w=a or t
  misc_feature 29: y=c or t
  misc_feature 33: k=g or t
  misc_feature 36: w=a or t
  misc_feature 47: k=g or t
  misc_feature 49: w=a or t
  misc_feature 52: k=g or t
  misc_feature 65: y=c or t
atactgtttgtggaatgygwttaaaggaytgaktcwagaacctttgkawatktgatagtatttcyaactttcatttctttac

SEQ ID NO: 34082 - DNA, 283 bp, Homo sapiens
taggcatggaaaggacttcagcaacaattttttggggttatttactaggggtggatctgctgctttaaggaataagtaagcaagtgataatattgactccttttctgaaaattccagattaaaaaaagatttccttttgattccaagattgtcccacattcagaggaaagagtaatagagaacctgcaggcaaagccaggatttttctgaaggaacaattctgtgtttgattcaatgcctgaaaaggaatcagttaagtcctcaaagttctttaaaacagagc

SEQ ID NO: 34083 - DNA, 306 bp, Homo sapiens
  misc_feature 252: n=a, g, c or t
ctgtgtggcctggtacatcaacgacatgaagaggaggcatgagcacgcggtccggctccaggagattcagtcactcctcatcaactggaaggggccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctcnctgatgctgatcgaaagcaccagagactccctgtgcttcactgtcacccactac

SEQ ID NO: 34084 - DNA, 359 bp, Homo sapiens
  misc_feature 324: v=a or c or g
aaacgagactgggcgcaatggctcacacctgtaatcccagcactttgggaggctgaggcgggtggatcacttgaggccaggagttcaagatcagcctggcctgttacatagtgaaaccctgtctctactaaaaaaaaaaccaaaaaacaaaaattggtctggcatggtagtacacgcctataatcccagccacttgggaggctgaggtaggagaatcacttgaacctgggaggtggaggttgcagtgagccgagattgtgccactgcacttcagcctgggtagtagagttaatgagactccgtgtcaaaaaacaaaaaacaaavcaaatgttctcaagtcatgttcaagagataatggc

SEQ ID NO: 34085 - DNA, 87 bp, Homo sapiens
  misc_feature 44: s=g or c
ttttaattttctataagcatggggtcttgctatgttgcctaggstggtctcaaactcctgggctcaagtgatcctcatgcctcagcc

SEQ ID NO: 34086 - DNA, 151 bp, Homo sapiens
atccagagataatttggaaaaatgtcctaccagtctcagatgcttctgtgggtctctttttatattatgtggcaatcaaaactgccatcaactgactgattatcttaccacaagaatttcaggatggtagactggctagtgatgggggccc

SEQ ID NO: 34087 - DNA, 183 bp, Homo sapiens
  misc_feature 118: b=c or g or t
  misc_feature 122: y=c or t
ctccatgtttcaaatcatttctcagtccttctcttacttagttgttggcaggtttgactcagttgatcactccctgtttcttaagtgtctcaggacattgctcttcatgttttcttcbtttyctcactaaatcctcttctcaatcggtctccttggctagttcttcttccttgtccagaccct

SEQ ID NO: 34088 - DNA, 83 bp, Homo sapiens
atgtttactgcagcactattcaccatagcaaagatctacaatttaaccaggtactaatgaattttagattaatttcctttttc

SEQ ID NO: 34089 - DNA, 313 bp, Homo sapiens
  misc_feature 17: d=a or g or t
  misc_feature 90: y=c or t
  misc_feature 94: r=a or g
  misc_feature 242: k=g or t
  misc_feature 280: b=c or g or t
ttatcaaatcagatttdattccctggactcccactctgaacccagttatttccagtcctgtttctttctctctctattgtaacttgttgytcaragaagtctctggagaataatatctgctgcaacaattactctattgtttccttgccttcaactattacaccctttaattagagttagtttggaagacatcacactgttgctctttgcaaatgtaaccttgcaacctggtatttttcctktctaaaaatgaaacaaaacaacaacaacaacaacatgbgctaaaccctccaccatgaccttcgttctaggt

SEQ ID NO: 34090 - DNA, 82 bp, Homo sapiens
  misc_feature 46: r=a or g
cactgtgttgaccaagctggtctcgagctgttgacctcgtgatttrccttcctcggcctcccaaagtgctgggattacaggt

SEQ ID NO: 34091 - DNA, 192 bp, Homo sapiens
acagtgttttctctcgctctctctgtttctagggaattcgggctgtgtttagctgctggaatatcgtagaattggttttcagagaagttcctccgactcctgaggcgaaacataaagggatgggagtggtgtgggaagtgatcgtgtggggaaaaaaaaaagtttcgagcccgtttcgcatttgtggagtac

SEQ ID NO: 34092 - DNA, 215 bp, Homo sapiens
tatattctgcttgtgaatagctggagcaaacctggggctgacacgcgtaactagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatcccgt

SEQ ID NO: 34093 - DNA, 183 bp, Homo sapiens
  misc_feature 95: k=g or t
ggattaagcaagcacagccctagttgatcacccagcatgaaaagtcctggaatctctcagagatgaacctgtgtatgggagttttgcttaaagtkggtacttcaagaaggtgcctctgtttactttggttttgcactgccatgcgaccaggtggtgcaggtctcccaaatgccacccccgaat

SEQ ID NO: 34094 - DNA, 91 bp, Homo sapiens
ttggctgttgattagtacagtacaagtgcgatttcaaaaagatcttgaaagtaatatatttaatcaattaaaatgtttatctgtcaaaaaa

SEQ ID NO: 34095 - DNA, 119 bp, Homo sapiens
gaaaatagaaatatgggtttgaaagatgtttttctcttagcacttaaaatatgttccactgttttctggcctccatgctttctgataagaagacattacttattaaaattagttccctt

SEQ ID NO: 34096 - DNA, 162 bp, Homo sapiens
aaaatcctccttaacatttctagaaagacttctttcaataaataatggaatcttagaggaaaagtggttttttaaaagctagggaactcctccactaaaagtaaccattggaaacctcgaaatgaagggctaaagttttaatcataagagaaaaggcagcgt

SEQ ID NO: 34097 - DNA, 50 bp, Homo sapiens
cactctgttgtactaccaaatactagggtcttatactttttttttttttt

SEQ ID NO: 34098 - DNA, 116 bp, Homo sapiens
tttacattttaaaacattatttctaatgtttagttctgttctttttttcttcatttattcatgtgaaacagggctcagtgttctcacttgccagcctaagccaaaaattagtggca

SEQ ID NO: 34099 - DNA, 86 bp, Homo sapiens
ctcttgtttttgggtatgggccaatgatgctgtaccttctctccatggtagccaaactctgcctcatatctttttttttttttttt

SEQ ID NO: 34100 - DNA, 285 bp, Homo sapiens
  misc_feature 112: r=a or g
  misc_feature 119: r=a or g
  misc_feature 121: s=g or c
  misc_feature 133: r=a or g
  misc_feature 136: w=a or t
  misc_feature 146: k=g or t
  misc_feature 166: h=a or c or t
gagtctcgctctgtcgcccaggctggggtgcgatggcgcgatctcggctcactgcaacctccgcctcccgggttcaggtgatgcgcctgcctcagcctcccaagtagctggratcacargsggtcaaccacargcwaaattttttkgtatttttagtagagacgahggtttcagcaggttggccaggctggtctcaaactcctgacctcgggtgatcctgagaggtgacaacatgctagcagccctcgggcgcctcctcggcctcggtgtctgctctggccccgc

SEQ ID NO: 34101 - DNA, 72 bp, Homo sapiens
cacttactttcattttgttggtggtttttctgttttgttgttgtttttctgtgggttttttttttttttttt

SEQ ID NO: 34102 - DNA, 165 bp, Homo sapiens
  misc_feature 129: m=a or c
cctcccaaagtgctgagattacagacttgagccactgcccctggcctattgatttcatttctatataacatccaacccttgtgagcccacccccaactcagaaacttgaaggtcactgcaatgcacctmagcctacgtggtcccgcctcccaacccagcccagcc

SEQ ID NO: 34103 - DNA, 205 bp, Homo sapiens
  misc_feature 123: m=a or c
acattcatcatgagtcaggcattcagtaatcctcacaatggccctagaaattggcctgtactattttcaacccttagggaggaggtgacagacacatagaacatctaagtaacttgccttgamaactccacaggcttgtaagtggcagggccaggctcttagccctaaaccatacattagagatttattatcatttaggtcccct

SEQ ID NO: 34104 - DNA, 233 bp, Homo sapiens
  misc_feature 110: s=g or c
  misc_feature 125: v=a or c or g
  misc_feature 132: r=a or g
  misc_feature 136: r=a or g
  misc_feature 140: m=a or c
  misc_feature 156: k=g or t
  misc_feature 183: m=a or c
  misc_feature 203: y=c or t
  misc_feature 204: n=a, g, c or t
  misc_feature 210: k=g or t
taccataatgtgatgtgttagaaacaaagggatatttcaaaggtagatatttgaaaattctctagtctcaatatgtatgtgtattgaatatactctaaaaattaatgtgsaaatttgcagtaggvcaatgcrgtgrctgmctagcattaggtatgkttcttttatatcctagctatgtcccamtttcttctaagtgcaatccynacatgktcacttgctgttttaccccatct

SEQ ID NO: 34105 - DNA, 161 bp, Homo sapiens
  misc_feature 128: k=g or t
tcacctgggctcaagcaatcctgccatctcagccacctgagtagttgggactacaggtgcaccaccacacccggctaatttttaaaaattattttagagatagggtcttgctatgttgcccaagctgktggcaaacttctggcctcaagtgatcccccgac

SEQ ID NO: 34106 - DNA, 191 bp, Homo sapiens
  misc_feature 113: k=g or t
  misc_feature 121: r=a or g
  misc_feature 129: r=a or g
  misc_feature 138: k=g or t
tatctttggagaaatgtctattcaggtctttgctaatttttgaattagtttttttgttagtggtggtgatgaattgttaagagttctttatatattctagatgttaatttctkatcagatrtatggatrgcagctatkaccttccactctgtcattcactctcttggtagtgccttttcaggcacaaaagt

SEQ ID NO: 34107 - DNA, 101 bp, Homo sapiens
tgtcttgacctaggtaggaaggtgactacgcagggggttatttcacaacaatctgttaagctgcacacttgggtttttgcttttttttttttttttttttt

SEQ ID NO: 34108 - DNA, 124 bp, Homo sapiens
  misc_feature 121: w=a or t
  misc_feature 124: k=g or t
attcttcgctgttttcctaactcgcccgcttgactagcgccctggaacagccatttgggtcgtggagtgcgagcacggccggccaatcgccgagtcagagggccaggaggggcgcggccawatk

SEQ ID NO: 34109 - DNA, 162 bp, Homo sapiens
  misc_feature 76: r=a or g
  misc_feature 85: k=g or t
  misc_feature 86: w=a or t
  misc_feature 89: w=a or t
  misc_feature 93: d=a or g or t
ataaaaatataattcaatttttggcaaaaatttatcttttcatctattgtctagatatgatgctttattttcttgracatattakwatwagtdaaagtctgtatcttataactacacttgaatcctatgttggagatgtttattgtttccccttgccgccat

SEQ ID NO: 34110 - DNA, 213 bp, Homo sapiens
caccataataccatcaagtcataatttctgtgatctcagtgcttcaagtaggtgtgtagcaattgctggatgtgtcctgagaactgtaccccttccaccctggcgagaagcaggggccagaaattcacacaagtggcatggctcattgattgtgggagactctggggggctcctagctagtgcattatgggaaccaggctgtggaggttgcag

SEQ ID NO: 34111 - DNA, 202 bp, Homo sapiens
ccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcaccttta

SEQ ID NO: 34112 - DNA, 353 bp, Homo sapiens
  misc_feature 60: m=a or c
  misc_feature 61: m=a or c
  misc_feature 302: m=a or c
accagtgttcaattttttatcttgttgagcttgtaaaatgccagcaatttaaaactaggmmttttccccccataagccaaggaggtagaattactaatacaagggttaaagaaggtagattttgttttcaatatttgggtaatattagaaagattcttcccacagggaagaactagcaagtgtcccaatttttttccaaacgttggggaggggaaaattcactgtatcatgaaaccctaagggtttgttgcacttcctgctttttaggcctggataacagtatcaccatccttatttacagmagggtaaaactgactcttaatgagaaaagctttataagttcaagggctggc

SEQ ID NO: 34113 - DNA, 152 bp, Homo sapiens
  misc_feature 89: m=a or c
  misc_feature 115: m=a or c
  misc_feature 118: k=g or t
atatggatcactctcctgttgccatccagctctccacagctggtgcccttgtgggcctggagtccagcatcctggttcaggcttctgtmtgcagtcagtgggcataccatgtacmtgkctagggaatgtggaaagaggtataattgtctacc

SEQ ID NO: 34114 - DNA, 374 bp, Homo sapiens
  misc_feature 16: w=a or t
  misc_feature 17: r=a or g
taggacttttcagttwratcacagtttgatcagcttttgcatttttggtagaaataccatgtctgtggtgttgtgtttttcatagtacataagattcaaaaggcgtatgatccccagaaaaacaaatgtttgttatatacactagtggtttgagaaacttactggctcataacatttattaaaattgaagccaggcttggttgggtgcagtggctcacacttgtaatcccagcagtttgggagactgagacaggcggatcacttgagatcaggagtttgaggccagcctagccaacgtggtgaaactccgtctctactaaaaatacaaaaattagccaggtatgttctcgcatacctgtagtcctagctactca

SEQ ID NO: 34115 - DNA, 357 bp, Homo sapiens
  misc_feature 86: s=g or c
  misc_feature 286: n=a, g, c or t
  misc_feature 287: d=a or g or t
  misc_feature 288: w=a or t
gtattaaattctggccagaaaccagggtcagtttagggcctgaggtctgctctcctcttttaagaaaaggctgaacaggtgcgcasaggggtcaaaagcctgtgctgtccacgttttctgctcctcctcctcctcaggtttggaggggcattggaaaggaaatgactttctcactgtgcaatgccaggctttgttcaagcatttgggaaaacaatgaggaggcagcttattcccagctccagatctgatggctggaactccagttgccatcttagatcattaagtndwagagacttgttgaagatggtggagcagcaacaacttagaaggagcctgggtctctgacaccgtggacat

SEQ ID NO: 34116 - DNA, 182 bp, Homo sapiens
ccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggtc

SEQ ID NO: 34117 - DNA, 158 bp, Homo sapiens
  misc_feature 89: r=a or g
  misc_feature 94: r=a or g
  misc_feature 112: r=a or g
cctcccaaagtgctgggattacgggtgtgagccaccgcgcctggcctataaattaatttttatctttaaaattgagcaaggggagtagrtagtrattaattgaagagagagrtagggaagagttacctatttgtaacatttgtatttagagtggcaca

SEQ ID NO: 34118 - DNA, 125 bp, Homo sapiens
  misc_feature 98: w=a or t
  misc_feature 108: k=g or t
  misc_feature 109: d=a or g or t
ataggttgttatggtattccttctcatgagatctgtgatggatggctgtgtgcccggtgcaaaagaaatgcgtggacagcagtaagtagcttattttwagtattgctkdacctttctccccaccc

SEQ ID NO: 34119 - DNA, 86 bp, Homo sapiens
  misc_feature 46: s=g or c
  misc_feature 54: n=a, g, c or t
  misc_feature 70: s=g or c
ataataacgagggggcttctggagggaggcggcagcgacggaggasggggctcntcagagaaagggaggsagggagccacccgggt

SEQ ID NO: 34120 - DNA, 99 bp, Homo sapiens
  misc_feature 79: m=a or c
ccttgaaacagaaattcataaagtacagaatttttttttaagttaaaaaacgaacaataatagacagaaaatgaatgamaaattaaatgtcatatcaga

SEQ ID NO: 34121 - DNA, 114 bp, Homo sapiens
  misc_feature 109: s=g or c
atttttagtagagatggggttttactgtggtggccaggctggtctcgaactcctgacctcgtgatccacccaccttggcctcccaaagtgctgggattacaagcgtgascacct

SEQ ID NO: 34122 - DNA, 83 bp, Homo sapiens
tcttgttgttgttggtaatagcataatgacagtgggaggggtacaaggggataagaaaaatgtcatgatttttttccggtccg

SEQ ID NO: 34123 - DNA, 363 bp, Homo sapiens
  misc_feature 351: s=g or c
acaaaagtttattcttaaatgtacaacagctccaagacaacacttaattccagccataggtggcaaaagatgttatggcagggaatagagaggtttaaatactgatgaaataaagggtcaccatctccttaggcacagggaacagcttactttttgccagatttcttaattccacttgtggccaagggccccttccccgtggccttccattttagctcctcgagtttcttctgctcctctttttgtttctgcttgaaagccttatcttcctcgtccatctccttggcctgcattcttgggctgtttcagtggcttcttgccaccttcgtggccggacatggcgcctgccgscccttccccatc

SEQ ID NO: 34124 - DNA, 336 bp, Homo sapiens
  misc_feature 245: r=a or g
gtttttctcttcattctgtctgttgttacaggagtcccagctgagaactcaaactggtagaaggaagattatttttccttctctataggtgcttggaggtaacgaggggaaaggagttgaaaggaaggtgacatttcagctaatctgcttcgcgctacttttttgaggtgggcacctgggatggaggcaaggaatcacgaagtgcgtctcctcggaaggggcagcctgatgtctttaaccactgractgtggtttccaactggatgcgctttgggttcagggctaagacacgcgtaggcggtgcagacagttcaattcgtgggcggctttttctct

SEQ ID NO: 34125 - DNA, 242 bp, Homo sapiens
  misc_feature 99: r=a or g
  misc_feature 102: r=a or g
aaagcggcgagtaagatggaagatgaggaggtcgctgagagctgggaagaggcggcagacagcggggaaatagacagacggttggaaaaaaaaaactgragrtcacacaaaaagagaggaaatccaaatctcctcccaaagtgcccattgtgattcaggacgatagccttcccgcggggccccctccacagatccgcatcctcaagaggcccaccagcaacggtgtggtcagcagccccaca

SEQ ID NO: 34126 - DNA, 302 bp, Homo sapiens
ttatcattttagcttgatattgaaaaatggatcagaattgcacaattcagaaatgaaaatgaatgctacttaaaagataatactcttagggaatgtggagctaattcattgtgaattacttgaggaaattgaactcacaacaagtatatagagacaggtccccaggttaaaaagtgagtcacagattttaaaaactcagagtattttgtgaccaatagcatttgaagttatgcaaatcagataaagataatcaaatctcataccacagcacagaaattgattgccccggggatccagcgcct

SEQ ID NO: 34127 - DNA, 394 bp, Homo sapiens
ttagcaaatcacagatgaaggtctcattactatatgcagagggtgccataagttacaatccctttgtgcctctggctgctccaacatcacagatgccatcctgaatgctctaggtcagaactgcccacggcttaggtaaacatttcttgtttagctcaaaaaaatcatagaacaaaagtttccttcacccatatttcttccttggaactttggaattttaaggtaggcactgcagacgctttgaaattttaaggtagtcccttttagatgcccacctacttcctttttgtacctcatttgatttcatgtaattggtgtgaaccaaggggtaacaatccccaaattccactacttgctatccatactagaaaaaagaatcaacattttattactt

SEQ ID NO: 34128 - DNA, 328 bp, Homo sapiens
  misc_feature 190: n=a, g, c or t
  misc_feature 293: r=a or g
  misc_feature 299: r=a or g
  misc_feature 305: r=a or g
gtttaatctttaaaatagctgatggaatataatatagaagattaagagcataagctgaggtactagcctggctgggttcatacccaagctcaaccacctgctaacaggggatccttgctcaagctgcttagcttttctatatctgtgttctcgtcagtaaaatagaaattgtagggctgggcgcggtggntcacgcctgtaatcccagcactttgggaggccgaggcgggcggatcacgaggtcaggagatcgagaccatcctggctaacacggtgaaacccatctctactaraaataraaaatraattagccgggcgtggtggaggt

SEQ ID NO: 34129 - DNA, 157 bp, Homo sapiens
cagttatcccagcaccgttgattgaatagggaatccttttctcattgcttgtttttgtcaggtttgttgaagatcagatagttgtaggtgtgcggcctcatttctgggctctctattctgttccattggtctatgtgtctgcttttgtaccggtact

SEQ ID NO: 34130 - DNA, 232 bp, Homo sapiens
  misc_feature 26: m=a or c
  misc_feature 127: s=g or c
  misc_feature 128: y=c or t
tttttatgatacgatagtgtcagggmgaaatgtaatgttctatatgaaattcctttttcaagtttgttcattaataacagttattaatttaaatcagcgttagagtttgtgctgcctgcaactgctsygaaaatttctctgagtaattctgatttgtgaatgatcccagaccaaccctgagattttgtcaacctgattaagtcaatatgaatgattaaaaagatgtgaaaac

SEQ ID NO: 34131 - DNA, 60 bp, Homo sapiens
  misc_feature 40: m=a or c
  misc_feature 41: m=a or c
cctatggatcaatatagtaataacaataaacaaatgatgmmaaaaatgggatatctcccg

SEQ ID NO: 34132 - DNA, 326 bp, Homo sapiens
tgttggtttcggatgctagatcaacctatacctgaagtaagccctacctctggactgatcagtaatatgaaccaataaggtccttttattgttctagtcagtttacattttctataaattaattactgaaatattcacaacagatgcattgcccaagaaagactttcctgctaccatcttcacaagtaactctctaatcagtcttcaataatatgggacaatgtaggcaatcagagtcaggggttcagcttccagtctaatgctgccacttatctcaagctgcacaataactgtaacaacagtaactacaagagactctttttttt

SEQ ID NO: 34133 - DNA, 137 bp, Homo sapiens
cagatagaaacacataaatccaaagggaaatgcaggccaaccaaaaaccaagcacaatattcctgtgtcctataggtcaaatgttatccactgtcaagatcagcttcgtttagattaacaacattaatccccaccac

SEQ ID NO: 34134 - DNA, 112 bp, Homo sapiens
atgtcgaggcgccaaggcgctcgtttggcgcgcgcgccctaggcggcggatctaagctaacttcttggatcttttcttgtttctccttggtttttgactttttctggacacc

SEQ ID NO: 34135 - DNA, 68 bp, Homo sapiens
  misc_feature 1: k=g or t
  misc_feature 18: k=g or t
  misc_feature 50: r=a or g
kactcaatgaggtaaaakaatgcatgcttgtaatgaatgagtaaatgtgrtctctcacaaggaaaagt

SEQ ID NO: 34136 - DNA, 205 bp, Homo sapiens
cgcaggctggccagccggcctactggcctccctccctctctccgtacaataaattagctaaaataatgaggtaatatctaagtcattgtagtctaggactgagtcatttttctctttgaaaaaattccagaatactttatattttcttgaaggtaacttttttgcacttgttttaaggtattgttactttatttacagccaacgg

SEQ ID NO: 34137 - DNA, 164 bp, Homo sapiens
tattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaataccccctc

SEQ ID NO: 34138 - DNA, 274 bp, Homo sapiens
  misc_feature 101: y=c or t
  misc_feature 107: m=a or c
acaaactccagatgtgttttacctggaatctgattatgcacagacctattcagctttgactatcactaaataacaaataagtttaggcagaaacaggagtyattcamcaaaatgtttcaggacttagactctggtttcagacagaccctggttcaaattctggatccatcagtttcaaactatgggaagttgactaattacttaacttctctaagtctcaggaacatcatctgaatatgtaaaaaaaaatagagcccacataacgagttgtcat

SEQ ID NO: 34139 - DNA, 230 bp, Homo sapiens
gttacttttaggcttactgctcccttgttaattatttataatgaactatggagctataggcttgctttagtgtgttaacctttatttgtgtcttgtttcaggcatttgtatattgttttctcatctggagagtgagctgcactgttttccttcagtgctgtttagaagagctttcggagaccagaaacatgttctttttgcattacccaatatggtagcactagccgccc

SEQ ID NO: 34140 - DNA, 188 bp, Homo sapiens
ttttggcttttgagtgtaatgctgccgtgaacatcagtatacaaatacctgttcgagtcctagctttcagtttgtttggatatatatgtaggagtgaaattgttgggtcatatggtaattctgtgtttaatgttttgaggaactgccatagtgtttttcacagcagctgcaccagtttacatccaacc

SEQ ID NO: 34141 - DNA, 134 bp, Homo sapiens
agtggtgcgatcttggctcactgcagcctctgcctcccgggctcaagccatcctcccacctagtggcagggtctgcaggcgcacgccaccggggcccagttaattgtttttggtatttttttggtagaggcagc

SEQ ID NO: 34142 - DNA, 214 bp, Homo sapiens
  misc_feature 92: r=a or g
tatactggagattaaaaaaaaaatggaaatttttgtggcttgctctggtgggcccctgacaatgactgatttcaagtttgatttcgggttgrattgattgattgatagaaagaaagttgcttttcttttgagaattaaaaactttggcttgatttcttttttccctttgcttatatctagcattagaattttgtcttaaaataacagcggtaag

SEQ ID NO: 34143 - DNA, 233 bp, Homo sapiens
acccttagacggtaatcaataaaacccatcaaaataacaatgaaggccacacggctaagtgctagtccccgtgctgaggataatttcctcacattcaggatcttatttaatttcacaacaatctgatgtgggccacaaagcactgttgttatcctcatttggcaataagaagactgagttctagagaggtggaataagcaacttggtgcagtcattttttttttttttttttt

SEQ ID NO: 34144 - DNA, 335 bp, Homo sapiens
  misc_feature 90: r=a or g
ttttgctgggtaggtgcagtagaaaatatagcagtctaagggaattgaggatgcagtgagagaataataaattgtgatggtgagtgctgratagggaaagacaagaagccagaaaaagactgagcttcttaggaaaacattaatggatcacaaacttggagggctgtatggtttttcatttaagaaagtaattgtcgtgcaataaagttattaagccttgtttaagaatatttttattttgtacatcaagtggagttggaaatagttggtttcataatgatatatttcaaaagtatcttgaagtcatctggttcatttcactacccagggcacaa

SEQ ID NO: 34145 - DNA, 124 bp, Homo sapiens
  misc_feature 93: v=a or c or g
  misc_feature 94: s=g or c
  misc_feature 95: r=a or g
  misc_feature 99: k=g or t
taacagaactaccatatgatgcagcagtccctttaccaggtatatattcaacgaaaatgaaatcagttatgttgaagaaatgcctgcacttavsrtatkcattgcagcattatttacgatagca

SEQ ID NO: 34146 - DNA, 116 bp, Homo sapiens
ttttattagacaagaggagtaggttcttgtgatctgttgtacagcatggtgactagagtgaataatgtatatttcaaaatagcttaaagaatagatttttaatgttctcaccaccg

SEQ ID NO: 34147 - DNA, 108 bp, Homo sapiens
  misc_feature 18: m=a or c
tttaagaacatgtatgamattgcatttatactctggaaaaatgagatgtaagtaggtattttgtattttttagcgtttcaagagcataattccccttatggtatgtct

SEQ ID NO: 34148 - DNA, 109 bp, Homo sapiens
aggaaaaaccctgggggacctgaagcaccccccacccaaacctgagctccattcttcctcttccccatgaatgaagagtttcacagctctaaggtaccacctccagcac

SEQ ID NO: 34149 - DNA, 192 bp, Homo sapiens
  misc_feature 94: r=a or g
  misc_feature 96: m=a or c
  misc_feature 158: s=g or c
cagctgggattacaggtgcctgccaccaaacctggctaatttttgtatttttagtagagatggggtttcaccatgttggccaggctggtctcgramctcctgacctcaggtgatccactcaccttggcctcgcaaagtgctgtgattacaggcgtgasctccgcgcccggcctttttttttttttttttttt

SEQ ID NO: 34150 - DNA, 310 bp, Homo sapiens
  misc_feature 17: v=a or c or g
  misc_feature 99: r=a or g
  misc_feature 233: r=a or g
  misc_feature 235: m=a or c
  misc_feature 291: m=a or c
  misc_feature 297: h=a or c or t
  misc_feature 298: n=a, g, c or t
  misc_feature 299: n=a, g, c or t
  misc_feature 302: d=a or g or t
atttagaaagaaaagavgtataattggttcacagtactgccagctatacaggaagcatcatgctagcatcttctcacgttctggtgaagggctcaggaragtttaaatcatggcagaatgcaaaggggcagacagccagcgtgtcaaatggtaacagcaggagggagagagaggagaggaaggtcacagactcttttaaacaaccaaatcttgtgtgaactaattgagggcgramtcacttgtcaccaaggggatgttgctacaacattgataaggttttctctcctatgmtacaahnnggdtcccacaa

SEQ ID NO: 34151 - DNA, 243 bp, Homo sapiens
  misc_feature 217: n=a, g, c or t
atttgagatagtctcacattgtcgcccaggctgcttggattgcagtagtacaatcttggctcactgcaacctctgccttccgggttgaagcgattcttgtgcctcagcctccagagtggctggtactgcaggtgtgcaccaccatgcctggctatttttttgtattttaatagacgggtttcaccatgttggcctggctggtctcaaactcctggcntcaagtgatccacccacctcggccca

SEQ ID NO: 34152 - DNA, 98 bp, Homo sapiens
  misc_feature 81: r=a or g
  misc_feature 83: r=a or g
  misc_feature 84: r=a or g
  misc_feature 87: r=a or g
ttagacagccctaccattgaccatgccctgctggacatgcccttcctttgactccctggggagatgccctctgacttctgrgrrcarctggaccaccc

SEQ ID NO: 34153 - DNA, 106 bp, Homo sapiens
  misc_feature 67: k=g or t
  misc_feature 72: k=g or t
  misc_feature 73: k=g or t
tgcccagcctagattttttgcccatttttaaatgagattatttgtcttatttctttttcttttcttktcttkkctttttttttgagagggagtctcgctctgttgc

SEQ ID NO: 34154 - DNA, 87 bp, Homo sapiens
ggcattataaatgtgttgccacactttgtttctggcctccatggtttctgccaaaaatcaacttatcattcagatggtaatttaact

SEQ ID NO: 34155 - DNA, 127 bp, Homo sapiens
  misc_feature 109: r=a or g
  misc_feature 115: w=a or t
  misc_feature 116: y=c or t
  misc_feature 120: k=g or t
cagggactggtagttggtggataaggtgaagcgagtggtaagctcatgctctctggggaggagagtgagaggataggactcaggctttgccgacgaccagaatattagrtattawyaatkgcccgac

SEQ ID NO: 34156 - DNA, 345 bp, Homo sapiens
  misc_feature 113: s=g or c
  misc_feature 119: m=a or c
  misc_feature 241: m=a or c
  misc_feature 242: s=g or c
  misc_feature 325: v=a or c or g
  misc_feature 326: n=a, g, c or t
  misc_feature 327: k=g or t
acctgatcagatgagtagatttggctgagaaaaaccctagagtaaggcaggcactttgtggaggtggatgatgatggctcataaaaacgtttgttctcagtccagttcagggstctgcmagcagtctttcagatttgaactgcttaaacaaaccctacagataaattggcactctgatttgtaattctgtttgtacaagtttagagcagcctagctcgagtcctcaaccccagtcctcttmsaagtgaactgattgcactggatccctaaacccacaatgttgaggacacatgtgatgactccacttgctcagccagctggcctvnkgcactttcccctgcccac

SEQ ID NO: 34157 - DNA, 288 bp, Homo sapiens
  misc_feature 124: w=a or t
  misc_feature 193: n=a, g, c or t
  misc_feature 194: m=a or c
caagctctgttgctggtggttgggggcggggatacgggggacaatatccctggcaccaaacaaatgcctggcacaaaggagacctcagtgaatgtttgctgaagaaaccaaggagtaaggattwacgtgcagggaagcaactcagacactgcaaagaaatattaaagaagggcaagtgcaaggggccctttcnmtccttcaatacatgtcagaaggagtggacagtggcgagacggtccctaaagggttttgaagcccaaggagggatggaggtttggccctggattt

SEQ ID NO: 34158 - DNA, 188 bp, Homo sapiens
  misc_feature 113: k=g or t
caaaaaaatgagcagggcgtggtggtacgtgcctgtggacccagctattcgtgagacttaggtgagaagattgcttgggcctgggaggttgaggctgcagtgagctatgattkgctcccagtttgggcaacagactgaaaccttgtctcaaaaaattaaaaaatgaaaaagaaaccagtaagtaggaa

SEQ ID NO: 34159 - DNA, 309 bp, Homo sapiens
  misc_feature 111: w=a or t
  misc_feature 299: w=a or t
atttagaaagaaaagaggtataattggttcacagtactgccagctatacaggaagcatcatgctagcatcttctcacgttctggtgagggcctcaggaaagtttaaatcawggcagaatgcaaaggggcagacagccagcgtgtcaaatggtaacagcaggagggagagagaggagaggaaggtcacagactcttttaaacaaccaaatcttgtgtgaactaattgagggcgaactcacttgtcaccaaggggatgttgctacaacattgataaggttttctctcctatgatacaatcwcctcccacaa

SEQ ID NO: 34160 - DNA, 259 bp, Homo sapiens
  misc_feature 107: y=c or t
  misc_feature 111: k=g or t
  misc_feature 115: m=a or c
  misc_feature 116: y=c or t
  misc_feature 119: m=a or c
ctaggctgcctcacatagcctgaggtgcttctcgcctatggcagggatgcagccatgggatcccggctcacagagcaccaggtaagtgaatgagcccactttgtacytgtkggamyttmaccctgggcgggtggagaagggctctgggccattccctggtctggtgtgtgggaataggtggggcaggcatcgtgtgactgtcagtgctactgacaggtggcagagccccctgaggactggccagcactaatttggcaac

SEQ ID NO: 34161 - DNA, 103 bp, Homo sapiens
  misc_feature 84: s=g or c
  misc_feature 93: r=a or g
  misc_feature 97: s=g or c
tattattgttgagtgaaccaaagcccagagacaggaagtgacctgcccaaagctgcacagcacattgttccgtgctcagcttastatacaacrccascttccc

SEQ ID NO: 34162 - DNA, 283 bp, Homo sapiens
  misc_feature 87: y=c or t
ttccagaatgtcatatagttggaatcatacagtatacagcctcttcagattggcttctagtcacctggcaatgtgcatttaaatttycctctatgtcttttcatgggttgatagctcatttctttttagcactgaataatattttggttgtaccacagttcacccattcatatactaaaggacatcttagttgcttccaggttttagcaattatgaatcaagctgctataaacattcatgtgtaggtttttgtgtagacataagtttgcacctccttggggat

SEQ ID NO: 34163 - DNA, 50 bp, Homo sapiens
tattttcttgtgagttcatctaaatgagtggaaggatgcctgtaatattt

SEQ ID NO: 34164 - DNA, 296 bp, Homo sapiens
  misc_feature 109: m=a or c
  misc_feature 134: w=a or t
  misc_feature 138: w=a or t
  misc_feature 139: r=a or g
  misc_feature 197: n=a, g, c or t
  misc_feature 200: h=a or c or t
  misc_feature 276: k=g or t
gcggcggcggcggcggagagagctggctcagggcgtccgctaggctcggacgacctgctgagcctcccaaaccgcttccataaggctttgcctttccaacttcagctamagtgttagctaagttttggaaagawggawraaagaaaatccctgggccccttttcttttgttctttgccaaagtcgtcgttgtagtcntthtgcccaaggctgttgtgtttttagaggtgctatctccagttccttgcactcctgttaacaagcacctcagcgagakcagcagcagcgatagcagcc

SEQ ID NO: 34165 - DNA, 61 bp, Homo sapiens
ttatgtgcaaaataattctggctaactgtaaaatgtattcaattttaggattttttttttt

SEQ ID NO: 34166 - DNA, 253 bp, Homo sapiens
  misc_feature 205: n=a, g, c or t
gtgtaatctcagctcactgcaacctctgcctcccaaattcaagtgattctcctgcctcagcctcctgaagtaactgggattacaggtgcataccaccatgcctggcacatttttgtaatttttagtagagacagggtttcacccatgttagccaggctggtctcaaactcctgacttcaggtgattcgcccccctcagcctaccnaggtgctgggaatacagattataggcatgagccactgcgcccggcgcc

SEQ ID NO: 34167 - DNA, 187 bp, Homo sapiens
  misc_feature 112: r=a or g
caaaacttgtaaaggtaatgaaatgcttatttgaaggagactgagaatgaactcaagaggaaaaaagtattttctccaaacattgcatatgtataaagcaaaaattttcagraattaagagaaggagaacatgtatgtgtttgggtgtttaagtttgaaataaaatgttgccaaaaggagggccgta

SEQ ID NO: 34168 - DNA, 257 bp, Homo sapiens
  misc_feature 116: k=g or t
  misc_feature 117: r=a or g
  misc_feature 124: y=c or t
  misc_feature 140: r=a or g
agagattatagcctagtagggcaaatggataagcaagtgagacattagagtacaatgtggtaagagacatgtaagggcaaccttggatcacacaggaaggatttgggggtttattkraaggctyctggaaagaagaaatrtttaaggtggtaaattaacttgttttaaattttttatttttgtgattaacactgtgagatatttatgtaccttagtccacttctgattgtatgttgagtgtgtatttctgggagaat

SEQ ID NO: 34169 - DNA, 372 bp, Homo sapiens
  misc_feature 119: r=a or g
  misc_feature 139: r=a or g
  misc_feature 323: v=a or c or g
  misc_feature 324: n=a, g, c or t
  misc_feature 325: n=a, g, c or t
  misc_feature 327: w=a or t
aatttttttatcttcacaaataaaacattaacaactacctatgcaatcttccaatactgagatattcaatagggaactgagagagagagagagaagggagaatttggggaagagaatargggtggaaggtgggtctttraattgttttgcttttaggaatagttaaaatattaagtagcctattacagtgtgaatagagcaagttttcagctaaactttctaacagaatctacatttgattcttctctctctgtagagaggcttacattcatttggaggggaactaatcccgtgacttctaggttatctcttagtttcttctvnngwatgacattattggcagacactagaggacttaagggagagcggcta

SEQ ID NO: 34170 - DNA, 122 bp, Homo sapiens
  misc_feature 114: r=a or g
  misc_feature 115: w=a or t
  misc_feature 117: s=g or c
  misc_feature 119: y=c or t
tattaaaaaaatcaaattgcagtctaagtcgctaaaacagggtttctcacctcagcattattgacattttagagtggataaatttttttgtgctttttagaatgtttagcagtrwtscytaa

SEQ ID NO: 34171 - DNA, 290 bp, Homo sapiens
  misc_feature 113: r=a or g
  misc_feature 119: k=g or t
  misc_feature 283: b=c or g or t
tagaaaatagtatagaaactactcaaaaaattaaaaatagaactaccatatgattcaacaatcttactactgggcatatattcgaaggaaatgaagtaagtatgttgaagagrtctttkgcactcccacgtttattgcagcagcattcacagtagccacaatacaaaccaaccattcagcagatgaatagatacagaaaatgtggtgcatatacacaatggaatactattaagcctttaaaaagaaggaaattcggtcatttgctataacatggatgaacctbaaggact

SEQ ID NO: 34172 - DNA, 279 bp, Homo sapiens
  misc_feature 121: r=a or g
  misc_feature 123: d=a or g or t
  misc_feature 124: m=a or c
  misc_feature 155: y=c or t
  misc_feature 156: n=a, g, c or t
  misc_feature 157: w=a or t
  misc_feature 170: r=a or g
  misc_feature 177: w=a or t
  misc_feature 192: k=g or t
cctattaattgatgcagtttcttcatagcatcaatggtctttacaatttggcatgtttttgcagtggctggtactggttgtttccttccatgcttagtgcttccttcaggagctcttttargdmcaggcttggtggtgacagaatctctcagcaynwgcttgtctgtgarggatttwatttctccttcactkatgaagcttagtttggctatgaaattggatatgaaattctgtgttgaaaattcttttctttaagaatgttgaatattggcccccgac

SEQ ID NO: 34173 - DNA, 232 bp, Homo sapiens
  misc_feature 118: s=g or c
  misc_feature 120: r=a or g
  misc_feature 206: s=g or c
  misc_feature 231: k=g or t
tagtcccagctacttagaaggctagggtgggcagactgcttgagctcaggagttcaagaccagcctggacaatatgatgaaaccccatctccacaaaaaattagctgggcgtggtggsargtgtctgtagtcccagctacttgggaggctgtggtgggaggatcgcttgagcacgggaggcggaggttgcagagagccgagattgsaccactgcattccaggccgggcaaka

SEQ ID NO: 34174 - DNA, 95 bp, Homo sapiens
tgcccaggctggtcttgaactctgagctcaggcaatccacctgccttggcttcccaaggtgctgggattacagatgtgagccaccatgactggct

SEQ ID NO: 34175 - DNA, 251 bp, Homo sapiens
ctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggccactc

SEQ ID NO: 34176 - DNA, 235 bp, Homo sapiens
  misc_feature 120: k=g or t
atatgtaaaaaatgttggcttctcttccccttgctgatcgtataaaaggactaagaactctcacaaactagaactggttcctgagaaattcacatttgttgaattagtattgattttatktatcttcagattacatttgttacaggtgtgtgccttttctgcaactaccttttgaaaagatagcctaattaaaagtctttctatccccccttcagaatttacaactgagatgcta

SEQ ID NO: 34177 - DNA, 340 bp, Homo sapiens
tttcctataggcaacatataggtgtgtaatgttttttaatccagccagtctatattttttaattgggaaatttaattcatttacatttcatggttattattgatagataagtactaattcctatcattttgttaattgttttcttgttgttttgtatatcctttgttccttttttccctctccttgtttattatttcagtttgttggttttctgtagtgataagattcgattcttttttctttcttctttgtgtatctgatctatcagtgagttttatactttcccatgttttcatgattgtgattatcatcttttcacttacggtaaccacccggctac

SEQ ID NO: 34178 - DNA, 231 bp, Homo sapiens
  misc_feature 92: w=a or t
  misc_feature 96: y=c or t
  misc_feature 103: h=a or c or t
  misc_feature 107: w=a or t
  misc_feature 208: v=a or c or g
cagtgattctaaacgctaattctcactgtctgtacttacaacatcactgatgggtagcaaattatctgtgggccacacttagaattgctgtwtttygtttgthtgtwtgtctgtttgtttttgagacggagtcttgctgtgtcacccaggctggagtgcactggtatgatcttggctcactgcaacctcctcctcccgggttcaagavattctcctgcctcagcctcccct

SEQ ID NO: 34179 - DNA, 172 bp, Homo sapiens
caataatgaagtgaaaaacatgtatatataaatacatacttatctgtggtaggtaatgtaccctgaagaattttccatgaaactggtgttatgcgatattaatacatatttagataatttggtatatgatttagagactgtatgatctttttttcttgtgatgatgggaaac

SEQ ID NO: 34180 - DNA, 101 bp, Homo sapiens
  misc_feature 17: k=g or t
ttagaagtatttcctgkatgtgcttaagattgttatgtttcaaaatatagtatcatgattggtgcagttttgtaagcaaacttttgttcccaccggattgg

SEQ ID NO: 34181 - DNA, 173 bp, Homo sapiens
  misc_feature 87: w=a or t
gtattagcaacgtattttatcttgagagcttgtacactgggctctcaacgtggtgtggaaggtagcctgttacagtgctggattcawaaaaagggcctttatggtttgtgaaagaatatctgtgtgcttagggaggaaactttttgatctgcagaaaagccagaagacatctt

SEQ ID NO: 34182 - DNA, 147 bp, Homo sapiens
cagaaatgtttgcctctctgagtaaaatgtttctttcagatgagccatagagggggcaccttttactcaacttttctttgttttgaaaactttgtttcccatactgttttcagccttttgtttataattagaaattgtgagaagcaa

SEQ ID NO: 34183 - DNA, 170 bp, Homo sapiens
  misc_feature 147: s=g or c
aggatggcttgagccagagagttcgagcctacagtgggccatgatcatgccactgctctatatcccaggctagagagcaggaccctgtctcagaaaagggttagaactggggttgaaacctgtgttagtatgatgactaaacccaastcttaacccttacatgctccccc

SEQ ID NO: 34184 - DNA, 203 bp, Homo sapiens
  misc_feature 99: k=g or t
  misc_feature 180: n=a, g, c or t
agcctcctcactcctccaacaacctgctgtcaaccacagcagccaacatctgatcatatcacttctgtttgtggttctcaaatctcccccaattgagtkacagtaaaagacaaacttggtgagtgccaccttatctctataactgtataccctttctattgctcactccagccagatgcnatatccttgccaagcaccctccc

SEQ ID NO: 34185 - DNA, 159 bp, Homo sapiens
gtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacccggcc

SEQ ID NO: 34186 - DNA, 137 bp, Homo sapiens
  misc_feature 112: w=a or t
  misc_feature 113: r=a or g
  misc_feature 119: r=a or g
  misc_feature 120: m=a or c
  misc_feature 122: r=a or g
  misc_feature 123: v=a or c or g
gttgtgaaaattaccaaaatgtgacacagatacatgaagcatacacatgctttgtaaaaatggcaccaacagacttgctggactcaggaatgccacaaaccttcaatttgtwraaacarmcrvcaaaaaacccccgc

SEQ ID NO: 34187 - DNA, 158 bp, Homo sapiens
  misc_feature 41: k=g or t
  misc_feature 114: r=a or g
aaatcccggtttagcagggcgcctggagtgaggtgactgckgaggctcgcagacgttaggtctgcctaaatccgaagcttccaccctcctctgcctctgtgacttgctgcgtgrcttttggaagctttcggaaactcagtttccctgtcttaagccca

SEQ ID NO: 34188 - DNA, 203 bp, Homo sapiens
atacgtatgcatctggtgtagcagttactttttagttttgaatttacttttgtggggatccttttcctaaggatgtatctgtggtgttagttgggtaaggtattttggctttgattctgtgtgcatgcagtagtgtggtctctgtatgatttctttgactgtacactttgttagttgcatgtgaaattccctccgtggcagta

SEQ ID NO: 34189 - DNA, 83 bp, Homo sapiens
tgcagtagtggtgcgaacttggctcactgcaacctctgcctcccaggttcaagccatctcctgcctcagtctcccgagtagct

SEQ ID NO: 34190 - DNA, 315 bp, Homo sapiens
  misc_feature 126: k=g or t
  misc_feature 127: v=a or c or g
  misc_feature 273: k=g or t
  misc_feature 274: k=g or t
cttaggggtaatttttctgaggaaggagaactagccaacttaagaattacaggaagaaagtggtttggaagacagccaaagaaataaaagcagattaaactgtatcaggtacattccagcctgttkvcaactccataaaaacatttcagattttaatccgaatttagctaatgagactggatttttgttttttatgttgtgtgtcacagagctaaaaactcagttcccaaatccccagtttatgcagcgccatcaggtattttaagctaaackkcttcacccctgagagcatgtcagctggagaaaagcagttct

SEQ ID NO: 34191 - DNA, 235 bp, Homo sapiens
aactactgcttccttcaggaagtcttcccaaatctgaagccagcacactggacccagctgattctaaggagcaggtgatactaagaacctctattctgcattatctattagctctctgcatttcccggtcataacacttaccaattcaatttaatgcaatattaatttattgagcatctgctacgtgtaaaggataacttggtgaataattagtgaataaaacatacaggatcca

SEQ ID NO: 34192 - DNA, 178 bp, Homo sapiens
  misc_feature 132: k=g or t
ttaaagttggagagagattagaggcagaattaacagaaaggagatgtgagaatccagtagtcatttaattttaaaaaacaggtattcaataaaattttatgattaaccatttatatttggctattcttattktttctttaaaattaacaataggaatccagaaacgtttcggaccacc

SEQ ID NO: 34193 - DNA, 141 bp, Homo sapiens
acctggaactggccatcgcgctcagcaaggctgacatgcctgccgcctaggcgagggccgtgtgtaggcgggacagggcacgggcgggttccagagagggggcagtgcagatgtctatatacacacacacacaccgccacc

SEQ ID NO: 34194 - DNA, 282 bp, Homo sapiens
  misc_feature 67: r=a or g
  misc_feature 77: w=a or t
  misc_feature 84: r=a or g
  misc_feature 89: k=g or t
  misc_feature 91: r=a or g
  misc_feature 97: y=c or t
  misc_feature 103: m=a or c
  misc_feature 114: r=a or g
  misc_feature 118: r=a or g
  misc_feature 124: r=a or g
  misc_feature 198: r=a or g
  misc_feature 225: k=g or t
  misc_feature 226: r=a or g
  misc_feature 243: r=a or g
  misc_feature 250: r=a or g
  misc_feature 256: w=a or t
  misc_feature 280: k=g or t
tacgtatttttgtaactctttgaaagtttatgaagactgacagctttccttgtaagcactaagagaraaaaaaagawagagggrcattkgrcaattytaaagmaacaacaagarattrgaatgraaatctgtgacaaacagcgtcagtgtggccatgtccacattcctacatgtctctctctacaagcacctctctargaagcctgacatcccggtggactcttkrtagtcatgtacacttgrttccagrtgagcwctggtcttatctggatgctcagakaa

SEQ ID NO: 34195 - DNA, 128 bp, Homo sapiens
  misc_feature 113: s=g or c
ttgtatttttagtagagatggggttccaccatgttggccacaatggtcttgatctcttgaacttgtgatccacctgcctcagcctcccaaagtgctgggattacaggcgtgascaccgtgcctgccca

SEQ ID NO: 34196 - DNA, 164 bp, Homo sapiens
  misc_feature 95: r=a or g
ttggtgatggaaatgtaaaattggactgtggtgatgtttacatagctctgtaaatttgctaacagtcattgaattgtacacttcaagtgagcgarttttatggtatgtaaattatacctcatgaaaacttacgtaaatggatgagcaaaggtgtaccaggccca

SEQ ID NO: 34197 - DNA, 328 bp, Homo sapiens
  misc_feature 319: w=a or t
ctcaaaaatggtttccttgcctgtgtgtggtggctcatggctataatcctagcattttgggaggctgaggtgggagggtcaacttgagcccagaagtttgaaaacagcctggacaacatagtgagaccccatctctatattcttcaataaagaaaaataaaagtttccctatcattgtacagaggaaaaacagaagttgaaaaaactccccccagaccgagttggggccaactttgatcacagctccaggaccagtgcaggctggctgccctcttttggccgcgtctggaataatggacgccgctggcagtccaggtawgtgtgttca

SEQ ID NO: 34198 - DNA, 263 bp, Homo sapiens
  misc_feature 76: r=a or g
aattcagccacattgccaccgtgccaggctcctgagttacaacgattcgtggccattttcttggccctggagatgrtttaggcacaggttgttccatcttcctagtccaagatgtacatagttgcagagaagtttggcttttcgttaaattgcaccctttcttcccagatgcacaccggctgcaccatgtcagcagcctggcctggctgaacgagcacacgctggtcacgacctcccatgatgcctctgtcaaggagtggaca

SEQ ID NO: 34199 - DNA, 165 bp, Homo sapiens
  misc_feature 94: r=a or g
ctgagttctaatttgattgcaatgtggtctgacagactgttggttatgatttccgttcttttgcatgtgatgaggagtgttttacttccaattrtgtgataaattttagaataagtgctgtgtggtgctgagaagaatgtatattctattgctttggggtagaaa

SEQ ID NO: 34200 - DNA, 238 bp, Homo sapiens
  misc_feature 76: r=a or g
caaagtcaagttaatgagctgcagagtaaacaagagtctctcgtagtttctgaagttcgagaagaaattctacagraagaggattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaa

SEQ ID NO: 34201 - DNA, 293 bp, Homo sapiens
  misc_feature 12: y=c or t
  misc_feature 13: y=c or t
  misc_feature 82: v=a or c or g
  misc_feature 86: s=g or c
  misc_feature 91: k=g or t
  misc_feature 92: b=c or g or t
  misc_feature 94: y=c or t
  misc_feature 112: y=c or t
  misc_feature 124: m=a or c
  misc_feature 213: m=a or c
  misc_feature 260: k=g or t
aagctttttgtyytgagactggagatagtttggtcagaagaagaaattctaactcatgattctatgaaaaaaaggaaatatvaagsatcckbcycctaattcagtcttccaycacctgcagggmgtccaattcttaaaaagtacttcacaaaagaagactgtgttttcaaagcaaactagattttaagaaaccctatgttcgaatgtaaatgmaaaagcaaacgagacattttctaaccttaaagcatactaaaagattkactttttcaagaatcccaatgtatggcaaattt

SEQ ID NO: 34202 - DNA, 198 bp, Homo sapiens
  misc_feature 85: r=a or g
  misc_feature 89: k=g or t
  misc_feature 90: b=c or g or t
tgaaattttaaaaaatatcctctagcaatatcatgagcatgcactaagtggtgaagctagaactagtgctagacaattcacctgraagkbccaataactttggaaccaaagttagatgtcataaaacactacatagaaggccagactactgctgtgacaatttaggagacagcactccgtaaaatatcagaggcaatg

SEQ ID NO: 34203 - DNA, 171 bp, Homo sapiens
aacaggttacctacataatgggaaaaaatttttgcaatctacccatctgacaaagggctaatatccagaatctacaaagaacttacacaaatttacaagaaaaaaaacccataaaaaagtaggtgaaggatatgaacagacatttctcaaaagaagacatttatgtggcca

SEQ ID NO: 34204 - DNA, 165 bp, Homo sapiens
tttattataccttaagttttagggtacatgtgcacaacatgcaggttagttacatatgtatacatgtgccatgttggtgtgctgcacccattaactcatcatttaacattaggtatatctcctaatgctatccctcccccctacccccaccccacaacaggccct

SEQ ID NO: 34205 - DNA, 248 bp, Homo sapiens
  misc_feature 88: m=a or c
tcgaatcctagtagttttacatttaaaaatataatattggccaggcgcagttgctcatgcctgtaaacccagcactttgtgagaccgmggtaggcgaatcacttgaggtcaggagttcaagaccagcctggccaacatggtgaaacaccgtctctactaaaaatacacacagaaaaattagccacacgtggtggcaggcacctgtaatagctatttgggaggctgaggcagaagaattgcttgaaccc

SEQ ID NO: 34206 - DNA, 172 bp, Homo sapiens
atgcaatgacttgagaacactctaactacatcctaacttatatgctattattgtatacttattttacctatatttaaaattttataagattattgtgtatagtcagtattcatttagttttagctatacattctttctgttattctttgtatcttcttgtttctagggccac

SEQ ID NO: 34207 - DNA, 156 bp, Homo sapiens
taaaaaaatgtcaggaaggattgctcttggggaagaaaaatgttacttgatgactttgtagtcttaaaggtagataaggttttttttgaaaaaaatccttactgctaataaccaaatacttaaaccttcttgatttcagcatttttaatggaaccc

SEQ ID NO: 34208 - DNA, 237 bp, Homo sapiens
agaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccagctca

SEQ ID NO: 34209 - DNA, 208 bp, Homo sapiens
  misc_feature 69: r=a or g
  misc_feature 104: r=a or g
  misc_feature 107: r=a or g
  misc_feature 117: k=g or t
gagtttacgatcccccatgcttttttcaaagttgctgaggggcgggaatcttcgttgcgggaagaagaraaggcaaatccggcctggaagcggggggccctgarctragagccagakaagggccatttcccttcccctggacctcggaatcgcccagctatctatccctggctcctggagaaacttgagggagggcccttgaccccca

SEQ ID NO: 34210 - DNA, 130 bp, Homo sapiens
  misc_feature 90: m=a or c
  misc_feature 116: y=c or t
ttgtatttttagtagagatggggttccaccatgttggccacaatggtcttgatctcttgaacttgtgatccacctgcctcagcctcccamagtgctggggattacaggcgtgagcyaccgtgcctgccca

SEQ ID NO: 34211 - DNA, 253 bp, Homo sapiens
  misc_feature 126: d=a or g or t
aaaacatgatactttttggttttctgtagccttggtgccattgttgatctttattaattatcattatcctcaaaatagccataatgtgctgagtctcttcctatttgctgggcagaggctgagtadttcagcgagctcactgagtccttaaaattgcattatgatagagagaaagagattattatttgcattttgcaaaatgaagaaattgagttttagagatacccaagggccacgtgagtgtgagtgccgt

SEQ ID NO: 34212 - DNA, 112 bp, Homo sapiens
tgtttttattgcttctaacctggattgaaatctatgactttttataacagtcattgagtctgtttcaaaggaatcttgtggtaagtatttttgcatgatgtactcaaggctg

SEQ ID NO: 34213 - DNA, 119 bp, Homo sapiens
  misc_feature 87: m=a or c
atcgttagagacatgcaaattaaaactacaatgagacaccatctcacaccagtcaaaatgcctctttctaaaaagtcaaaaaaatamcagctagtaaggttgtggagaaaagggaacga

SEQ ID NO: 34214 - DNA, 183 bp, Homo sapiens
  misc_feature 85: r=a or g
  misc_feature 86: s=g or c
ggcagagcttgggcctgggctcacgaggaaggggctgcagttctccaaggattcccgcctgctcccagacccccgggagtcgtarsgaacccgttcctggacgctgacgtcggctttcagggatccctcgccggacgccgcggagggacagagcttgggaagccgtcgccccgccccgtcccc

SEQ ID NO: 34215 - DNA, 350 bp, Homo sapiens
  misc_feature 222: w=a or t
aaaaacagaaggaaagaacttctccagaggataattgtggagcttgttgaatttatatctcccaaaacccctaaacctggagaaacttgggggaagaatatctgggtcagtggcttggagagtagcccgaggtgaaatgggtctacagagaaaagaaaccttgtttattccctgtgaaaatgagaagatttctaaacagctccacctttgttacaatattgwgaaagatcgttatgtttgagtttcaaataacaatcaaaccatttctggatgggagaatggcgtgtggaaaatggaatctatattcagaaaagttgaaacagactggcacatggtatatttggccctaa

SEQ ID NO: 34216 - DNA, 264 bp, Homo sapiens
  misc_feature 19: r=a or g
  misc_feature 65: s=g or c
  misc_feature 105: y=c or t
  misc_feature 106: y=c or t
  misc_feature 179: m=a or c
  misc_feature 186: m=a or c
taaaacattgtagggtttrcagtggaagaaatcatttatttcttccttgattagtagtaatagasacatgagtcagtgtctataaaatggcacttaactaatttyyttcttttattaagttttatttcacaggcttaaccaatacgtgttaaaagcaagttacattttctcttttaggmaattatmcattttctctcagtaagtgtttatgatgcacttccattgacaagacttgaaggactaaaggatcttcgaagacaactg

SEQ ID NO: 34217 - DNA, 375 bp, Homo sapiens
  misc_feature 17: w=a or t
  misc_feature 302: k=g or t
aaaccaaaaagatatawagtccaccattcacttccttaatgataccagatgcatttaaataggaatttcttaaacttttgtactttgacatgctgataagctccagaatgatattatatattagctaaagatgaattatgggttttgggtttccatttccttaaatcaacagcatgttcagttacagcacattgctaagggttaattttcaaaccaatgagtggtgagaagggctagtgaaaataaaaggggaaaaacccaactataactggtaaaactctttctatgtgaataatattttktcttttgcatttgctgtgtcttctggaggaatgacagttgtgtaattcagtctggttggagagacaggcaacg

SEQ ID NO: 34218 - DNA, 264 bp, Homo sapiens
  misc_feature 77: k=g or t
  misc_feature 81: k=g or t
ttttcaaaaccttaacctactgggaaaaatgtaaaccagttttatggaacatgatgatattattttatttatttatktatktatttttgaggtgtagtctctgtcgcccaggctggagtgcagtggcatgatctcgatcttggctcactgcaaactctgcctcccgggttcaggcgattctcctgcctcagcctcccgagtcgctgggaatacaggcacgcaccactgtgcctggctaatttttgtgtttttagtagagacgga

SEQ ID NO: 34219 - DNA, 225 bp, Homo sapiens
ttaataccattttactctctgcctttatgagtctgactttttaggttccacatataaataagattatgcactatttgtctctctgtatctggcttattctacttagcatacaatttgccaggttcatctaaattgtcacatatggtataaatttccttctttattaaggctggatattattccattgtgtgtgtgtgtgtgtgtataaccttcaccaccccttga

SEQ ID NO: 34220 - DNA, 285 bp, Homo sapiens
attctaaaagggtagggggtgtacgaacagggagtaggtcacaaagatcacatgcttcaaagggcaaaagggagaacaaagatcacatgcttctgaggaaacaggacaagggcaaaatcagaactactgataagggtttatgttcagctgtgcacgtattgtcttgataaacatcttaaacaacagaaaacagggttcaaaagcagagaaccggtctgaccacaaatttaccagggcagagttttttccccaccctaataagcctgaaggtactgcaggagacaa

SEQ ID NO: 34221 - DNA, 249 bp, Homo sapiens
  misc_feature 31: r=a or g
tcgaatcctagtagttttacatttaaaaatrtaatattggccaggcgcagttgctcatgcctgtaaacccagcactttgtgaagaccgaggtaggcgaatcacttgaggtcaggagttcaagaccagcctggccaacatggtgaaacaccgtctctactaaaaatacacacagaaaaattagccacacgtggtggcaggcacctgtaatagctatttgggaggctgaggcagaagaattgcttgaaccc

SEQ ID NO: 34222 - DNA, 64 bp, Homo sapiens
  misc_feature 17: w=a or t
  misc_feature 42: k=g or t
ctctcaagcttggcgtwtgtttggtggggttacacgcgggtkcaacatgcgtatcgaaaagtgt

SEQ ID NO: 34223 - DNA, 124 bp, Homo sapiens
  misc_feature 66: s=g or c
tatcttgacacctagcacaaatgttttggttaagtatcttaaaactgatggatggtatggcgtgascactgcacctggcccagaagtagatttttaatgctgatgtcagggtagacaggcagct

SEQ ID NO: 34224 - DNA, 205 bp, Homo sapiens
cagtagtcaatgaatggaacaatgtcttgtgagcccctatcacttgtctcatacggagaaacagggcagctcattaccagagccctgggcaccacatccactagtttgtaaaacttaggttttacacatctcccatcatcacgggtggaggctctgagaatgacactaactcacaactactacttcttatgcgaacccctcctcc

SEQ ID NO: 34225 - DNA, 68 bp, Homo sapiens
atgcacacttgataatgctttgatagtagtgctggtctgttttgcttttttttttttttttttttttt

SEQ ID NO: 34226 - DNA, 281 bp, Homo sapiens
  misc_feature 88: b=c or g or t
  misc_feature 89: w=a or t
  misc_feature 97: y=c or t
  misc_feature 98: k=g or t
ctgctgcctcaaccacctggactcaagtgatcctcctgagtagctgggactacaggtatgtgccaccatgcctggctaatttttcttbwtgtatttykaaatagaaacagggtttggccatattgcccaggcttgtctcaaactcctgagctcaagggatcttcctgccttggtctcccaaagtgctgggattacaggcatgctccactgtgcccagcctatttttcttatttgtagggagaccaaggcaggaagatcccttgagctcaggagtttgagac

SEQ ID NO: 34227 - DNA, 416 bp, Homo sapiens
  misc_feature 15: m=a or c
  misc_feature 60: r=a or g
  misc_feature 80: r=a or g
  misc_feature 88: s=g or c
  misc_feature 284: h=a or c or t
  misc_feature 285: n=a, g, c or t
  misc_feature 286: n=a, g, c or t
  misc_feature 287: n=a, g, c or t
  misc_feature 312: w=a or t
  misc_feature 313: v=a or c or g
  misc_feature 358: s=g or c
ttatgggctctgggmgacagctttagggaataaatggggattttcccctttttctacccrctcctttgcttcctccaagrcttagccsaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaahnnngggatatgttatctgacagaccagwvtatttgaagtttgggctgtcctgaaagtctggactttggtggtascctcctcccccagcccatctgttgcacattatactccgtgtgttcttcaactttcggc

SEQ ID NO: 34228 - DNA, 232 bp, Homo sapiens
  misc_feature 81: r=a or g
  misc_feature 90: k=g or t
  misc_feature 110: m=a or c
  misc_feature 136: r=a or g
  misc_feature 194: s=g or c
  misc_feature 196: s=g or c
  misc_feature 207: r=a or g
  misc_feature 208: s=g or c
  misc_feature 209: y=c or t
  misc_feature 210: w=a or t
  misc_feature 231: d=a or g or t
tagtcccagctacttagaaggctagggtgggcagactgcttgagctcaggagttcaagaccagcctggacaatatgatgaraccccatckccacaaaaaattagctgggmgtggtggcaggtgtctgtagtcccarctacttgggaggctgtggtgggaggatcgcttgagcacgggaggcggaggttgcagasasccgagattgcrsywctgcattccaggccgggcaada

SEQ ID NO: 34229 - DNA, 360 bp, Homo sapiens
  misc_feature 87: r=a or g
  misc_feature 276: b=c or g or t
  misc_feature 297: w=a or t
ctgttttttggattaaggtaacactagcctcatagaatgagttaggaagaattcccttctcatttgttttttagaagaatttgtaarggtaggttttaaaattctttcaatatttggtagcattcaccagtgaagccatctgggcctgggcttctcgttgtgagtttttttaattactaatttaacctctttacttgctatagatcaattttttatttcttcttgagtccatttcagtaatttgtgtctttctaggaattgttcatttcacctagbttatcttaatttgttgatatwgaattgctcatagtattcctttataatcctttttgatttcttaatgccagtagttctccctca

SEQ ID NO: 34230 - DNA, 258 bp, Homo sapiens
  misc_feature 83: m=a or c
ctcaagtgcgcggtctattactttgtaatatgccactgtgagtactgacatttacagttgtttaaaggtggagcactggaaamcagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagtgctgtactacagtagttccctgaaga

SEQ ID NO: 34231 - DNA, 332 bp, Homo sapiens
  misc_feature 85: r=a or g
  misc_feature 106: r=a or g
tagtcaagggatgcctaatggaaaacagtaccagctggctatgggttccctcatcttcaagaagaaggaaactaaaactggctgrtttcaatagcaagtactgaaratgaggtaaatgaataaagatgttatttgcaaaatgtctgatgtgtcaaaattcactatccatctggagattgtttaaatgtggtctgctagactggggtgaagaatagttcttctcggttggcccccaaaccatctgtacctcgattacctgataagcttgtgaggttgcagtctccagggtttctaacccaagtcttagggcaggaacagagaagctgaaattt

SEQ ID NO: 34232 - DNA, 66 bp, Homo sapiens
aacaggttacctacataatgggaaaaaatttttgcaatctacccatctgacaaagggctaatatcc

SEQ ID NO: 34233 - DNA, 264 bp, Homo sapiens
  misc_feature 89: s=g or c
  misc_feature 90: r=a or g
ttttcaaaaccttaacctactgggaaaaatgtaaaccagttttatggaacatgatgatattattttatttatttatttatttatttttsrggtgtagtctctgtcgcccaggctggagtgcagtggcatgatctcgatcttggctcactgcaaactctgcctcccgggttcaggcgattctcctgcctcagcctcccgagtcgctgggaatacaggcacgcaccactgtgcctggctaatttttgtgtttttagtagagacgga

SEQ ID NO: 34234 - DNA, 119 bp, Homo sapiens
caaaacacaaagggagactgcaagagagaagagatgaaggaagaagactaacataaagcaactaacaaaatagcaatagtaaattcttccctagcaataattacaggaaacgcacattc

SEQ ID NO: 34235 - DNA, 212 bp, Homo sapiens
  misc_feature 95: m=a or c
  misc_feature 198: y=c or t
  misc_feature 199: m=a or c
  misc_feature 204: h=a or c or t
attgccagtgtgcggtctttgttctcctccgtgaaaaactgtgtccgagaacactcgggagaacaaagagacagtgcacatttgttttaatgtgmcatcaaagcaagtattgtagcactcggtgaagcagtaagaagcttccttgtcaaaaagagagagagagagagagagagagaaaacaaaaccacaaatgacaaymacaahacggactc

SEQ ID NO: 34236 - DNA, 56 bp, Homo sapiens
  misc_feature 5: s=g or c
cttgsaacagaagaacttcggcaacgagaacactatctcaagcagaagagagataa

SEQ ID NO: 34237 - DNA, 173 bp, Homo sapiens
tccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctct

SEQ ID NO: 34238 - DNA, 260 bp, Homo sapiens
aaagtttaatatgactaaatgcagcaaggctttaatgcgttatggcaaagcatattttcaccaggtaaacaaccttttatgggtctattgactgaggacagaaaaaccctttatagtctagaacccagagattgagtctgcttgccatctacactgaagcaagacttcaggaccttgaaccttaggttgataatctcacaactgagaaggggccctccaaattcttgcaattgtatgcccattggagttttttttttttt

SEQ ID NO: 34239 - DNA, 157 bp, Homo sapiens
agaataggctaaaaaaaatggtacagacatgtgtattacgtttggattagatttctttgagttttaacagattggctaattgtaacccaaacttttctctccaaaaagtatgcatgtcatttaaaattaattattttgatttgaatcttgcctgagt

SEQ ID NO: 34240 - DNA, 211 bp, Homo sapiens
  misc_feature 83: r=a or g
atacaggttagaaatatgcttttgtttttgaacaataatatactggtttgctttaaagaagggactaaatatgactttaaagrgacttcaaaatattgagtattttaaaaatttaaaagtaggtcagtttataacgagtaaatacctaacacaccaagaatgtgcagtgaacctcaggcatttaagacacctcccccaccgcccacccccc

SEQ ID NO: 34241 - DNA, 151 bp, Homo sapiens
tacaaaaattagccgggcgtggtggtgcacacctgtagttccagctacttaggaggctgaggtgggaggatcgattgagcccaggaaggtcagggctgcagtgagccatgattgcatcactgtattccagcctgggtgatagaacaagact

SEQ ID NO: 34242 - DNA, 159 bp, Homo sapiens
tagatggattccttcctgaagcagtagtacacaagtgatagaggttatgattaactagaaactatgaggaagtaggaggagttaggaatccctctgaggtttccagctagggtgattaacagacagggtatgcaaaccaaggaggcttgatgggggcct

SEQ ID NO: 34243 - DNA, 75 bp, Homo sapiens
  misc_feature 71: k=g or t
ccttgccagcattcgttattgcctggctttttgataaaagtctttttagctggggtaaaatgatttttttktttt

SEQ ID NO: 34244 - DNA, 143 bp, Homo sapiens
cactcgttctcaacccctttagcccgctttgtttttctccagagcactcatccgtcactagtatttttattgaatattcaatgaccctttccttcctcccaggcctccaggccgtaagcatcgagagagcctgagtccctcgc

SEQ ID NO: 34245 - DNA, 87 bp, Homo sapiens
  misc_feature 32: r=a or g
tctccataaaacttgactaatttctccaactrtagatgatatctacctccattttgaactctggtattccattactatcttttcctt

SEQ ID NO: 34246 - DNA, 266 bp, Homo sapiens
  misc_feature 198: k=g or t
  misc_feature 199: v=a or c or g
tggtagcaaatatgaaacatctattatgttgatttagtgcagagctggcattaaaatttaatcatgttgtagctggctctttttatgggctagttttatttaggagggcctgccttgatcaatcatatatccaaattcaggtaaggatgagtataaagaatttccatggagtgagtaattgaacctttggttctcaakvattggtagtatattcctggtcacatagtacatagacctgggtcctctacttcttggttacccaacta

SEQ ID NO: 34247 - DNA, 389 bp, Homo sapiens
  misc_feature 81: s=g or c
  misc_feature 82: r=a or g
  misc_feature 94: r=a or g
  misc_feature 95: r=a or g
  misc_feature 120: r=a or g
  misc_feature 121: k=g or t
tataaaagtcaactgtgtttacaagtattagcaatgaacaactggaagttgagattttaaaatactatttacaatagcatsraaaattaaaatrrttcaagctgggtgctgtagctcagrkctgtaattccagcactctgagaggctgaggtggtcaaatcacatgagctcaggattttgagaccagcctgggcaacacaggaaaacctcgtctcaacaaaaaatacaaaaattagctgggcatggcggcatgcacctgtagtcccagctactcgggaggctgaggtgggaggatgatttcagcccacgaggtagaggctgcaatgagccaaaacggcatcattgcactccatcctgggcgacggagactccatctcccaaaacaaaca

SEQ ID NO: 34248 - DNA, 109 bp, Homo sapiens
  misc_feature 87: r=a or g
  misc_feature 88: w=a or t
  misc_feature 93: k=g or t
ccattatacctttcaagtcaacagcaaagcagacagcctactctaattaatgtatccattctaagggaaaattatattaaatgttarwatttkgaaatgtggtggccgc

SEQ ID NO: 34249 - DNA, 302 bp, Homo sapiens
  misc_feature 87: y=c or t
  misc_feature 88: w=a or t
  misc_feature 238: n=a, g, c or t
  misc_feature 240: n=a, g, c or t
  misc_feature 300: k=g or t
  misc_feature 301: n=a, g, c or t
  misc_feature 302: k=g or t
cctgtaagatattattttcatccccatttacagttgaggaatttgagggtcagagaggtgaaataacttgcttaaggccgcataacywagtaaatggtaacacactggggtttaaaccgccacctgtctgattccaaagtctgtgttcctcttaatcacaaactgtttctaatattgagaggaccatctgtaaataggtgcatatatacaaattgagaatgtacatattttccttcancnttaagtaatatagtcagataatacatagaaagttaatagtccttcaaatcagccatagcknk

SEQ ID NO: 34250 - DNA, 176 bp, Homo sapiens
  misc_feature 91: r=a or g
  misc_feature 99: r=a or g
  misc_feature 100: r=a or g
tactaattattgagcatctactatgcatgtgtccagaaatgggcagtggggaggaaaagtttatcttgctcgagcttgctgcctgttgggraagatagrraacagtaaattacaatgacggatggctttactcagaatagaatctggagttgtgagaactgtcaggagggtgcgcc

SEQ ID NO: 34251 - DNA, 292 bp, Homo sapiens
tttttctctgcacataccaaagtatagtagtaatttaggaacaacaagagcaaagggtgactcttgagattttgagcctggatggcccaggagagagctctgtgctttttcttgattcctcctaacaataatttgttaaacaggagggagaggacagagcaggtaaatgataatatcagtaactacttggaaatagtgattttcatactgcttttaaaagaggaataaactggtttcagtagatgaccttatcccaagagtaattgagttccccctcacttttgaaccagca

SEQ ID NO: 34252 - DNA, 70 bp, Homo sapiens
  misc_feature 25: s=g or c
gggaagttggggttttgcgggggasggggagtattagtacgttgcatgaaatagcttactttataatgat

SEQ ID NO: 34253 - DNA, 340 bp, Homo sapiens
  misc_feature 42: m=a or c
  misc_feature 71: n=a, g, c or t
  misc_feature 72: n=a, g, c or t
  misc_feature 137: s=g or c
  misc_feature 138: w=a or t
  misc_feature 139: n=a, g, c or t
  misc_feature 241: m=a or c
  misc_feature 310: v=a or c or g
cagtttaattttttagggttgaatttacagaagtgagtaggmaattaaattgctttatttcttctaaaacnnggacacaaaatcataaggttagaacacattcagttgaaatgactgttaacaaccaacagagctaswncagatagcaattttcattgacacttgaaatacccagacagaaaaaaggagaaactggagtacagatttacgaggttggagttggaggacaccctggtgtggmaaacaacaaaggtttgggaagggggcagtccttagattggaaagggcacacctggtacagatggtgtgvtaaaaagtgtggtaaaatgcgagcgagctc

SEQ ID NO: 34254 - DNA, 230 bp, Homo sapiens
taatttttgcatgttctgtatagttatggtactacatagctgaaatgttatattaataaggagttcttatattattatgatgcttccacaggttctatggaaagaaatttttttctgggttctttgttgggcttctttaactctcttaattgtagtaatttcattttagactaaattaacatcactacatgtgtataaaagttaacagatttaaacataatgaagtggcc

SEQ ID NO: 34255 - DNA, 124 bp, Homo sapiens
catccttgattctttactttctcttaacaccctgtatccagctggtcataaatctagcagatgctacattcagataacatctggaatctattttccctattttctacttctactaccctgcccc

SEQ ID NO: 34256 - DNA, 189 bp, Homo sapiens
  misc_feature 30: y=c or t
atagaaattagccaggcgttgtggtgccayctgtagtcccagctacccgggaggctgaggagggaggatcgcttgagtccaggagtttgaggctgcagtgggctatgatcacatcactgctctccggcctgggcaacagtgcaaggtcatgtctcaaaaaaaaaatcccagctggcttttttttttttt

SEQ ID NO: 34257 - DNA, 75 bp, Homo sapiens
caaaggagtgaacaaaattgttaagatgttacttagtggaggattttcatttaactcctaattcttttttttttt

SEQ ID NO: 34258 - DNA, 300 bp, Homo sapiens
caaaaatgttcatgttctaagatagcctcatgtgaaaatgttaaataatgaattgcataaagtaattactaatcaaactacattatgaccaactttaagaaactggcttcagccaggtgcggtggctcacgcctgtaatcctagcactttgagaggccaaggtgggcagatcacttgaggtcaggagttcaagaccagcctggccaacatggtgaaaccccgtctccactaaaaatacaaaaattagccaggcatggtggcacgtgcctgtaatcccagctacttgggaggctgaggcag

SEQ ID NO: 34259 - DNA, 160 bp, Homo sapiens
agaaccttcctgccgtcgcgtttgcacctcgctgctccagcctctggggcgcattccaaccttccagcctgcgacctgcggcagaagaaaaattacttattttcttgccccatacataccttgaggcgagcaaaaaaattaaattttaaccatgagggaa

SEQ ID NO: 34260 - DNA, 176 bp, Homo sapiens
  misc_feature 30: s=g or c
  misc_feature 66: s=g or c
  misc_feature 93: m=a or c
  misc_feature 101: s=g or c
  misc_feature 131: s=g or c
aaaaaaagttgagttgggagaagttgggascggcgggggcacgaagtccagagcgagcgggttatscctccgcctcgttgccctgaaagccgmagcgacasgtaaagggctaagattcggccatgagcagsgcccctcggcgccccgccaagggcgcagattctttctgtacgcct

SEQ ID NO: 34261 - DNA, 161 bp, Homo sapiens
  misc_feature 55: m=a or c
  misc_feature 56: w=a or t
  misc_feature 64: m=a or c
acttttacattttaatcaaagctttaatttaatcatacattttaatttttgaggmwataagggmgattttgtggttaaggctgagtcattttcacaaacagaaaagaacaattagcacattcatttatttttatttcagtttatatttatacacaagacct

SEQ ID NO: 34262 - DNA, 168 bp, Homo sapiens
  misc_feature 101: k=g or t
tgattatatttttgtgataatttctggcctgattgaaggaaatttgagaggtctgcatttatatattttaaatagatttgataggtttttaaattgctttktttcataaggtatttataaagttatttggggttgtctgggattgtgtgaaagaaaattagaaccaca

SEQ ID NO: 34263 - DNA, 186 bp, Homo sapiens
  misc_feature 91: k=g or t
ctaaaaactgtattattaacaggtattttcgagagactttctgactaatgtgcagaaacaatcacatttaatctgaaagctcccctgtcakgctaagtgtcaggttccagcccaagctgaggtctgatagaagtcagtgggcgagtggtgggttgctggaaaaacactcgaggaattgtgggcctc

SEQ ID NO: 34264 - DNA, 178 bp, Homo sapiens
  misc_feature 91: r=a or g
  misc_feature 92: k=g or t
aggtttcaggatttggggatcttcagagtaaggatcaggaagatgccaaataggaactcagtgtctgaaaggcgtgaggcacagcagaggrkgggaaaccactgatgctaagggagagttcgagctcccggtggattctagagatagcagctgctgcgatcaaagacaacccaggata

SEQ ID NO: 34265 - DNA, 55 bp, Homo sapiens
ccaaaacaaacttaactgcctgccaaaacacagctcagcactctttaaaggaaga

SEQ ID NO: 34266 - DNA, 148 bp, Homo sapiens
  misc_feature 87: r=a or g
  misc_feature 88: r=a or g
ccaaatctacgtctgattggtgtacctgaaagtgatggggagaatggaaccaagttggaaaacactctgcaggatattatccaggarraacttctccaatctagcaaggcaggccaacgttcagattcaggaaatacacagaacgccc

SEQ ID NO: 34267 - DNA, 58 bp, Homo sapiens
  misc_feature 23: s=g or c
  misc_feature 24: k=g or t
  misc_feature 36: k=g or t
  misc_feature 37: k=g or t
ctatgccaatatttccttatatskatccataacatkkatactacatttgtaagagaat

SEQ ID NO: 34268 - DNA, 310 bp, Homo sapiens
  misc_feature 298: k=g or t
  misc_feature 303: k=g or t
catttcctaaatgcttaggcatctctctgtaatcatcccatgggaggagaagtcccaacttaccatgacatttcaggaagaccaccaataattattcctggagcatctttctctcttcatttcagacttttccgccatagcccataatcccatcattcttgtctgtagtctttgtaaagttgcttgacaccacagctgtataaacactgaagtaatggagggttttttcccctttagcatttgttattgtgaaatttagaaatttataaagcaaggaaaataatttgaaaggtatgtktacakaaagcgc

SEQ ID NO: 34269 - DNA, 202 bp, Homo sapiens
gagctttctcccctcttccctggagagcgactgctcgggagggtgagaatggtataaatttcaaaaacaacgaaaccttcttttgccccctccgcagcagtcgcctccgggctttattgcaagtttacggttccatacaagtaaatccgaaaaaaagtgtgtgtgggggggtccacaccactaattattatggcgaggaagg

SEQ ID NO: 34270 - DNA, 276 bp, Homo sapiens
  misc_feature 217: n=a, g, c or t
  misc_feature 218: r=a or g
  misc_feature 221: s=g or c
  misc_feature 274: k=g or t
ctttggagctaagtgaagaatgacttctgttaggttttcctctgctggtcttccttgcagcctcgaaaacctcaccagagtcgcctctgctggtctcttactgtgctgctctgtcagagatgggcaagtaagcgaactgcagagtgttgctgtgtgtgcttgtgatttgtattttatttgatgtaaacgtgaaggcagagtattttctaacactgtnrttsaactaggttttgtgtctcctggatctatttttttttcttgttgttctgaggaktc

SEQ ID NO: 34271 - DNA, 335 bp, Homo sapiens
  misc_feature 129: w=a or t
  misc_feature 243: w=a or t
  misc_feature 246: n=a, g, c or t
tggatactttataatagcagagtcttcttactcttgttcaatcctttattccccagcagttagagctgtcctgctgggcacagtggtgcacacctatagttccgctacttgggaggctgagtcaagagwatctctggagcccaagagttcaaaactgtagtgtgcgatgatcgtgcttgtgaatagccactgcactccagcctgctcaacatagtaagacccagtctctaaaaaagtaataawgcngtggtccctggcatatggtataggcatagagttcagtatatattatatgcattttcagccacctcgcccggtcctatctctctttcttc

SEQ ID NO: 34272 - DNA, 296 bp, Homo sapiens
  misc_feature 275: s=g or c
  misc_feature 296: d=a or g or t
aaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaasaacaagcaaactgaaggtggd

SEQ ID NO: 34273 - DNA, 200 bp, Homo sapiens
gtatgcccatagtttgaggaaatgttttacttgagttttctgtgtgttgagatgaaagtctcccaggctaaagatttctgaactgcacgcaatgtctgaagaagcgcttgaaaggcactttatttctcccaggtccccaaccatgggtttaggtttttatgccagaaaggggaccttcatgaacaaagacccccaagacc

SEQ ID NO: 34274 - DNA, 359 bp, Homo sapiens
  misc_feature 87: w=a or t
  misc_feature 90: r=a or g
  misc_feature 92: m=a or c
  misc_feature 260: n=a, g, c or t
  misc_feature 348: r=a or g
tgtattaagaaaggactataaaattataacacatatggctgtggggcagattgaaaataatttaatcttttgaccgattgcagttawggramcttggaatgattcatcatttatataagttatcattgctaccccaaaacagaaatattgtcaccgggtgcagtggctcatgcctgtaatcccagcattttgggaggccgagacaggcggatcacaagttcaggagatcaagaccatcctggctaacatggtgaaacccngtctttactaaaaatacaaaaaaattagccgggcgtggtggcgggtgcctgtaatcccacctactagggaggctgaggcagaagaatraatggcatgaa

SEQ ID NO: 34275 - DNA, 214 bp, Homo sapiens
  misc_feature 212: n=a, g, c or t
  misc_feature 213: k=g or t
  misc_feature 214: r=a or g
catctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacaankr

SEQ ID NO: 34276 - DNA, 332 bp, Homo sapiens
  misc_feature 216: n=a, g, c or t
tccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttanttgaggcatacctcactgttacgcacactggtaatttaaccatgcccctaagtattccttttctcctgcatttgatgcagcccaacaaagcttttgttttgaaataaatttgacta

SEQ ID NO: 34277 - DNA, 198 bp, Homo sapiens
  misc_feature 34: r=a or g
cttggccaatcaggaagcgggggagagcggcgcragaagcggcggccgcgtcctcaagccggcacctgagcggcggagacggctgtagcacaaggatctgcatctccaatggatactgaggggtttggtgagctccttcagcaagctgaacagcttgctgcttgagactgagggcatctcagagcttccccatgtgga

SEQ ID NO: 34278 - DNA, 161 bp, Homo sapiens
aggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcacc

SEQ ID NO: 34279 - DNA, 76 bp, Homo sapiens
atgaagtctccaagcggatctctggagtgtcagagaagttcagtggccgcgggtcagggacagatttcacacaaca

SEQ ID NO: 34280 - DNA, 271 bp, Homo sapiens
  misc_feature 211: n=a, g, c or t
  misc_feature 212: w=a or t
tctctggaggtactcagttccagtttgcagaatggttttcatacatccgtgggtaatgcatgaaaaggtcatagtctgccagcgggaagcagcttctgtgtgcgctgaccctgccgcccttctctccaagcccccaagttgggtccaaaagcaaatgtgggtgggaatacagacccattgttgtgatctgtaagccaagcgatcctgagcnwggggagcacatcctgtgaatttgagtgacagatctgctttaaaattttacgaatagccg

SEQ ID NO: 34281 - DNA, 225 bp, Homo sapiens
  misc_feature 224: h=a or c or t
  misc_feature 225: r=a or g
gatacagaatgagaaaatgaacttagaaatactgagtgctggccgggcgctgtggctcacgcctgtggtcccagcactttgggaggccaaggtggggagatcacctgaggtcaggagtttgagaccagcctggccaacatggtgaaaccttgtctctactaaaaatacaaaaattagctgagcgtggtggcatgtgcctgtggtctcagctgctcgggagggchr

SEQ ID NO: 34282 - DNA, 399 bp, Homo sapiens
acttacaaatgaatcaagatgatgaagatgtagtcaacagggctgtgataataatagtaaggcctccagtcttaccttagatagttagtatagtcactgttctaatgagcaatgagaaggaagaaagggacaatgtgagtctttaaaaaagaaaagaaaacttaaaaaggcatctcttaactatgtactaaagatcagaacataacttactcatgatacccacagtatttcatatgaatctcttacaactttttttgtttttttgagacggaatctcgctccattgcccaggctggagtgcagtggcgtgatctcagctcactgcaacccccacctcccaggttcaagccattcttctgcctcagcctcccgagtagctgagactacaggcatacacca

SEQ ID NO: 34283 - DNA, 224 bp, Homo sapiens
aaccctggagtgaagcgctttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagac

SEQ ID NO: 34284 - DNA, 290 bp, Homo sapiens
  misc_feature 81: k=g or t
  misc_feature 87: r=a or g
  misc_feature 88: k=g or t
  misc_feature 241: r=a or g
  misc_feature 243: k=g or t
  misc_feature 248: d=a or g or t
  misc_feature 251: r=a or g
  misc_feature 253: w=a or t
  misc_feature 265: s=g or c
  misc_feature 269: k=g or t
  misc_feature 277: w=a or t
  misc_feature 283: w=a or t
agtgacgcgttgtgttgaacaccagttttctggagcgctgtgtgttcttaacagctgagcagtctgtttctccaatcaggkttcaarkccacttcaactgcactggcccctgtgggtcactgctgcaccgccctgacccatgtgggtccctgaggagcgacctgccggggccacctggctggacgaaaaagacacaccttggacttaagccgtgagaaaaaaacttcatcagtaagaagartkaatadacrgwctaggttgaatscatkacaatggwatgttwgcagacc

SEQ ID NO: 34285 - DNA, 105 bp, Homo sapiens
  misc_feature 13: w=a or t
  misc_feature 15: w=a or t
  misc_feature 17: w=a or t
  misc_feature 21: w=a or t
  misc_feature 70: y=c or t
  misc_feature 96: m=a or c
cccacccgcgccwcwtwctcwctcttcctccagctggtcccagagcccggcttggtccggtccctctgcycccatcccgcacccttccacctcctmcgagtccca

SEQ ID NO: 34286 - DNA, 222 bp, Homo sapiens
  misc_feature 110: k=g or t
  misc_feature 113: k=g or t
  misc_feature 125: k=g or t
gcttacaaagggctttaggctgtcctatgccacccaaatttaattgcaaacacatacaatgactactttccccaaccatttggacaaagtctagtttttaaacctgagtkaakgttgcttgttckacttcccaaagcctctcacactatgctatctcactgacccagcaaagtcttctctttctctgaccacacaatccttttcacgggaacacaaggacaa

SEQ ID NO: 34287 - DNA, 173 bp, Homo sapiens
tgtttcttttaagttgaatttatgaactcagaattgttcatagtattattcccatgttattcttttaatgttagcaaaatctgtagtgttctctttgttttcattcctgacacgatgatttgtgttttcatgtctgtgagtcttaggtttgtcaactttattaattaattaat

SEQ ID NO: 34288 - DNA, 60 bp, Homo sapiens
cattgccagctcttccaatctccatcacctttgggcttgttttctactttgccacagatt

SEQ ID NO: 34289 - DNA, 177 bp, Homo sapiens
  misc_feature 146: w=a or t
acagattctccgggatattaccggagacggagtgttttattattagcctttcttaggtggacatttccatttgaattacaagtcctttaggctgggcgtggtgcatggctgtaatctcagcaccttgggaggctgaggcaggaagwccacttgaggccaggcgttggagagcagcca

SEQ ID NO: 34290 - DNA, 205 bp, Homo sapiens
tgactccatcagatagctatccatacacaaatgcaacatgacaaacaaccctcaaaatcagcggtttaaaacaataatcctgacacctccccagaattacattctgctatgcttcttgtacagcctgcagaactgttagtcaattaaatcttttattataaattatccagtctcaggtatttctttataacagggcaagaacatc

SEQ ID NO: 34291 - DNA, 198 bp, Homo sapiens
acatccggggaagaagacacaggtggctggtcatggagagcccgctgggggaagagcacacagacaggcaccggcaagccattgaccaaacgggacaaggtgggctcaatgtcatcacaagggtgcttaagagggaaagaggaagccatgagggtcagagtcaaaggaagacttgaagatactacactgcggactttc

SEQ ID NO: 34292 - DNA, 230 bp, Homo sapiens
  misc_feature 82: r=a or g
  misc_feature 85: r=a or g
  misc_feature 91: k=g or t
  misc_feature 97: y=c or t
cctggtttaacaacagtgccctgtttacaacagattgtgccctatctcatctgcagccgaggaataaaggattctgattagraargagggkttgccytacaggattagtaagcaattccttggatcttatgcacagaacttgtaccatttgaatctgttttatgcttaaatcaaagtgctttgatcaaatgcataacctgccatatctttacatatttgttggtagcttc

SEQ ID NO: 34293 - DNA, 121 bp, Homo sapiens
caataaataaataaataaagtaaagtaaaaaacctattaaattgaggctagagctggagatgtaattggtttttgagaaacattagtataaagcttgcccttgttgtgtggaagaagccat

SEQ ID NO: 34294 - DNA, 178 bp, Homo sapiens
tgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccca

SEQ ID NO: 34295 - DNA, 149 bp, Homo sapiens
atccctcggagactagccttgcagtgttttagactgttttgaaattctgttctttagaagagattttttttttcttcttaatatcaaacaaagaactgctgctattcctttgggctggcgcacaggggccggtgaaatgcaggctgacg

SEQ ID NO: 34296 - DNA, 414 bp, Homo sapiens
  misc_feature 17: s=g or c
  misc_feature 174: w=a or t
  misc_feature 176: n=a, g, c or t
  misc_feature 177: k=g or t
  misc_feature 186: n=a, g, c or t
agggcatgtcttcggcscaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagawanktttgaatangactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagacctaacagagaggacgagctgct

SEQ ID NO: 34297 - DNA, 284 bp, Homo sapiens
  misc_feature 101: m=a or c
  misc_feature 125: y=c or t
  misc_feature 176: k=g or t
  misc_feature 192: n=a, g, c or t
  misc_feature 194: s=g or c
  misc_feature 244: k=g or t
tcttggcatctttattgaaaatcagttgacagtaaatgtatggatttacttctggattcactgttctgttccgttagtgtgtgtgcttttatggcccgtamcatgctgttttgattactgtagcytgatagtagattttcaaattaggtaatgtgaagcctctggatttgcttttkgctcaagactgctttngstatttggggtcatttgtggttccatatgaattttaggattttttttctgkttctgtggaaagtgtcattagataaagattgcattcagtc

SEQ ID NO: 34298 - DNA, 60 bp, Homo sapiens
ccactgtaaatactataatgagagccacatctgtaatttaaatgtttctagtaaccacat

SEQ ID NO: 34299 - DNA, 71 bp, Homo sapiens
cctggttttagtgtgtgtgtcgggggagtgtgtacctatatataaaggacaagtgtgatatgtgtgtatat

SEQ ID NO: 34300 - DNA, 74 bp, Homo sapiens
ctctttactccttagggctaagttttccaccatcaaaacaagtctttgcttccagtttacagaaaaagaaaaga

SEQ ID NO: 34301 - DNA, 57 bp, Homo sapiens
aaaatccatggaagatcatggacatgtgaaatgagcatttttttctttttttttttt

SEQ ID NO: 34302 - DNA, 427 bp, Homo sapiens
tgaagaattttaacagagttccattttaaaacattatttagtcaatggtatggaaaaaatattagtaaaggaacaaaagtaggttaagggaggccaggtaggagacaattatattctcaacaagtgattgcaggaaatataatgtggaaatgcctgggtatgagagagaatttggaagcagaatggacaagacttggtaattgtttggtaagagaggagaaggtgagtgaagaatcatgtgaaacatagtttggtttctagcttaagtaactgagctcctttgagtgataggaaacatttgaacagcagcaggtttgtattgttatgtttcattgtgtatgcatgaatttgaggtacttgagagacctcagagtggggacatcaagtggctatctgggtataagaataaggagaaagttctggatta

SEQ ID NO: 34303 - DNA, 240 bp, Homo sapiens
  misc_feature 132: n=a, g, c or t
  misc_feature 133: r=a or g
  misc_feature 159: d=a or g or t
  misc_feature 200: k=g or t
aaaatttccttttgaagtttttttttaaaaaactttgtataaatgaaaatagttcttcactgtgtttttgattttggcattgttttccttaaattacaaagcaaacaatacatagtaatgtctactcgcaanrgtttgtaagatttttcttttaacttdctgtagacatcctgacaaggatatttctttgtttatatgtkctatactgatatgtgaatgatttttttgcaaaggggtcgc

SEQ ID NO: 34304 - DNA, 152 bp, Homo sapiens
tcctgggtttcagcaattctcctgcctcagcctcctgagtagctgggattacaggcgcccgccatcacgcccggctaatttttgtatttttagtagagacaggattttgccatgtttgccaacctggtctcgaactcttgacctcccgatcc

SEQ ID NO: 34305 - DNA, 301 bp, Homo sapiens
  misc_feature 7: k=g or t
  misc_feature 11: k=g or t
  misc_feature 75: k=g or t
  misc_feature 258: r=a or g
ataactkagtktgcctgatggcagaacacactgcagtgttatcagtgtctgcatgttttttaatagaacaggttkacttgatctgtcatctgttatggaaaaaacagcaattacttttgcatccatctagctaaatctataatctgtgtcaatcacttatacctatcaatcatccgtatctattcacctgtcctctatgtctgtcttctctcagtctgcatccatctagccttctgtcaatcatctactttttttttratagaacaagaagtttacttatcaagtcttgaaaggaggacac

SEQ ID NO: 34306 - DNA, 239 bp, Homo sapiens
  misc_feature 133: w=a or t
tatttttagtagagacggggtttcaccatgttagccaggatggtctcgatctcctgacctcgtgattcgcctgcctcggcctcccaaagtgttgggattacaggtgtgagccaccgcacccggccagataggwctttcttgacgccctcacaaccctctccctctctactgtttctctggagaactctgactaatacagctttccccaaatgccaaaacaaaatgaggtgtcccagcaa

SEQ ID NO: 34307 - DNA, 192 bp, Homo sapiens
  misc_feature 38: k=g or t
  misc_feature 47: k=g or t
  misc_feature 78: k=g or t
  misc_feature 81: s=g or c
  misc_feature 82: k=g or t
  misc_feature 157: r=a or g
  misc_feature 171: r=a or g
  misc_feature 172: r=a or g
agcgggaactgcgccctccaaggcgtccagtcaccttktcgtgggtkcctctcacagcgctcggccgtcgagcggggkcgskaacccggcactctcttcggacctacgacatcgcggcttctctggcgttggccagtcagccacagggaactagtaraaaaagaaaaagarraaataaagtgaaagaggctc

SEQ ID NO: 34308 - DNA, 213 bp, Homo sapiens
agactgatttgtcctgggagatcactggatccctcattcaggtggagtgctgcaggacgacactttttccaggggtaacccaggcctgcagggtcccagtgtcacaggcaggccttgcccgagcctccacctgagcccctgctcctcttctcccacagggaggtggaggttacagtgaggtgagttcaggccactgcacttcagcctgggcaa

SEQ ID NO: 34309 - DNA, 63 bp, Homo sapiens
  misc_feature 17: r=a or g
  misc_feature 56: y=c or t
catctttgtatattctrgtctgttaccaaaaatggaagttgctttctttttttttyctttttt

SEQ ID NO: 34310 - DNA, 175 bp, Homo sapiens
tgcttggagttgtttttgctgtcagtctgtcccctggtcctcatgacagaggccaccttctccaggagcaggcggttgtccctctcgatgacggagagccgttcctcctccagctggggacagagaaggaggctggaggagcgccggcagattgcgaggctcttcctcacgccac

SEQ ID NO: 34311 - DNA, 284 bp, Homo sapiens
  misc_feature 2: y=c or t
  misc_feature 17: n=a, g, c or t
  misc_feature 25: y=c or t
  misc_feature 65: n=a, g, c or t
  misc_feature 83: y=c or t
  misc_feature 119: y=c or t
  misc_feature 142: k=g or t
  misc_feature 146: y=c or t
  misc_feature 260: y=c or t
  misc_feature 261: b=c or g or t
gyaaccgaggagtcaanaaattggyctcggaaagagggtcgtggtcccgcacggatgcgcttgtngggagaaaccttggagaytcacggcaaggcgtaaagcctggggcgtccaacgayactctgggcagggatggaagcckagaygcctcaccgcaaggagcggccgagcgggtcctcgcttcacacacacggcagcaccggcaccgcggagggaggaaacatgtcccggctgtctctcacccggtcgcctgtgtctcybctggctgcccagggcatccccct

SEQ ID NO: 34312 - DNA, 157 bp, Homo sapiens
gagggttccgggtgtggagtctcgagcctgggttgcacctgctcttggccgggaggtgactcccagagccgcaatgccagctcatgaggatggctttacccaggacgcgttcatgatgccagcaaggcagagccaccaaaacagaaaaatggaagta

SEQ ID NO: 34313 - DNA, 126 bp, Homo sapiens
ttcctgagatgtcgttatcattctttgactctcctttctatagtcagacatttggctctcagaggtgactttctggctgaagaatgtggattcgtcactgtcttgtgctcaatgtagagggggctc

SEQ ID NO: 34314 - DNA, 154 bp, Homo sapiens
ccatatctatagtttctctatcctacttatgtctgaataaaaatgattttttaggtagataacacgattttaaatgatgaatagttttttacttttacatagtattagctctttaaatacgtcagtaagggagacatagagcagagacccgcaa

SEQ ID NO: 34315 - DNA, 427 bp, Homo sapiens
ctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaaatcatcagaatgcattcttttttttttcggaga

SEQ ID NO: 34316 - DNA, 357 bp, Homo sapiens
  misc_feature 230: d=a or g or t
  misc_feature 307: r=a or g
ttcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactdtcatatatcataacagtgactgatgttggttgtaatggttgggtttaggatgaaccattttaaggatgccaaatgaratattagtatttgtacacagaaagaatttattgatttgatcttattacct

SEQ ID NO: 34317 - DNA, 408 bp, Homo sapiens
aactacctacctaagcgatgaaatccaaaggtgaatcttttggttggtgattttgatgatagccacaaagcaagcaggagtctcactctgtcacccaggctggagagcaattgcacaaacacttggctcactgcagcctcaacttcttgtcctcaagtgatcctcccaccttagcctcctaagtagctgggaccacagagtctcactctgtcacctggggtggagtacagcagccggatctcagctcactgcaacctccaccccctgggctcaaccgatcctgccacttcagcctccagaggagctaggaccacagacacgcactaccaagtcaggctaagtttttggttttttttggtagagagggggtttcatcatgttgccaggctggtcttgaactcctgaagc

SEQ ID NO: 34318 - DNA, 351 bp, Homo sapiens
  misc_feature 116: k=g or t
  misc_feature 293: n=a, g, c or t
  misc_feature 344: k=g or t
  misc_feature 345: n=a, g, c or t
gaaggccacaaagcgctccaaatgtcctcgtgcagattccacaaaaagagtgtttcaaaactgctctatcaaaataaaggttcaactctgtgagttgagttaacacttcacaaatkaagtttctgagaatgcatctgcctagtttttatgttaagatatttcctttttcaccataggcctcaaagcacaccaaatatccacttgcagattctacaaagagagtgtttcaaaactgctctatcaaaagaagggttcaactctgtgagttcaatgcacacatcacgaagatgttnctgataatgcttctgtctagtttttatgtgaagatattctccttttgaacknaagcca

SEQ ID NO: 34319 - DNA, 355 bp, Homo sapiens
  misc_feature 71: s=g or c
cggaggactatacagagaaggcaggttttgtgaaggccaggcagggttggaggccgggggtgtgagaggasaggcccatagggctgagtggggtcgggtgaggcagaggtcagaaacagaagagctgcagttgctggagctgggctgagaactgggctgcctcctgccatccccccgtctcctccccttctccccttggtgcccccctctgctcagaatctgaagtagttccctcctcagcaatttcatctcttgaacactgactcacaccttttaggcacctactgtgtgcatagcattccaccaggactcatctcccttccttctcagggggtcccgagccccgactagcttt

SEQ ID NO: 34320 - DNA, 205 bp, Homo sapiens
  misc_feature 193: k=g or t
cataaaacctaagcaactggcactacacccaaagcatctcctagaaatggagtttataagtcagatttttgtaaacgtgattgtgttttaaagacatgttagaaggatgctacttaaaagcagcttaagtatactttaaatggatgaattgtatggtatgtgaagtttatctcaatgaaacttttttttttckaaagaagcagcc

SEQ ID NO: 34321 - DNA, 79 bp, Homo sapiens
  misc_feature 17: w=a or t
  misc_feature 22: r=a or g
  misc_feature 25: s=g or c
  misc_feature 27: v=a or c or g
  misc_feature 33: s=g or c
  misc_feature 41: s=g or c
  misc_feature 44: s=g or c
  misc_feature 55: s=g or c
  misc_feature 65: w=a or t
aaaaaaacttcaagggwacctraascvaattgscaccaaascascagctgtattsccgcagttcwagcttcaccttcac

SEQ ID NO: 34322 - DNA, 270 bp, Homo sapiens
  misc_feature 93: s=g or c
  misc_feature 95: s=g or c
ctgctctgccgcctgccaccgctgcccgagcccgacgctatgtccagcaaaggctccgtggttctggcctacagtggcggcctggacacctcstscatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggcctaa

SEQ ID NO: 34323 - DNA, 341 bp, Homo sapiens
agcagctagagtgctgtctagccaggtgaccacagttctccctactgtccttcaacttgcgagtttgtttcaatcatattatgtccagaattggtgggttcttggtctcactgacttcaagaataaagccgcggaccctcgtggtgagtgtcacagttcttaaaggcagcgtgtccggagtttgttccttctgatgttcggatgtgttcggagtttcttccttccggtgggttcatggtctcgcaagcccaggagtgaagctgcagaccttcgtgcagtgaaggcagtgaggggctgtggtgtgatccaggaggctgagaattatgcagtgggtgctgtca

SEQ ID NO: 34324 - DNA, 459 bp, Homo sapiens
  misc_feature 163: h=a or c or t
  misc_feature 195: n=a, g, c or t
  misc_feature 196: n=a, g, c or t
  misc_feature 317: k=g or t
  misc_feature 318: w=a or t
caaacagaagaagtttttggaaatatttaacaaaaagccaacccactcatggccatcatttagcactgggtaggggtaaagagaaagagaaaccctttgaggtatgtggtagcatacaaacatgttcacagtaaccttcctgtattaaccattttctaacaahtacaatgccacatcaacacagttagttgttgnnaattctcaacatggctaaatacttagattgcattggtggtgtgcctgtgaaagctatttgggggttgtgtatgtggttctgctcattggaaagacagaagagagaaagggggccggaaagkwtactgggagaaaacagaaacaactattcctggtgaaagtgtgtgggcttctgagggcggttgtggcagctgagaagtgctggttatatatagctgggtcacagtgatggggaggtggggatggtggtggatgactgtgtca

SEQ ID NO: 34325 - DNA, 155 bp, Homo sapiens
  misc_feature 8: n=a, g, c or t
tctacttngggagagggcacagattgcagaggtaatgctgtggcatattgcttctgcctcagtgtatcactggagtcacaggaccctgcccacctgagttcccaataaagaaaaacctccccttctgaggctgctttgccaaaactcccccttaa

SEQ ID NO: 34326 - DNA, 152 bp, Homo sapiens
agcatcggcagtcgccatcaccgccagaccgcagagacaggttcggatccgcggtcctcttgcctcattccaggcctcgatgagtgttaaatcgccatttaatgtgatgtcaagaaataatttggaagcacctccttgtaagacgacagagc

SEQ ID NO: 34327 - DNA, 134 bp, Homo sapiens
  misc_feature 130: n=a, g, c or t
ctctttcaccactgggcgctgcgcgctgcccttccctccgcgcacaggctgccggctcaccgcttgctaatggcagccggggtctccctgggacagcaagacctccgctcaggcccctctttcgaatgcnccac

SEQ ID NO: 34328 - DNA, 402 bp, Homo sapiens
  misc_feature 331: v=a or c or g
  misc_feature 332: d=a or g or t
  misc_feature 333: r=a or g
acatagaaagccagacccagacaaaaggaagccaaagcgtctaaggattaagacaataatagttatgattgtggtagcttgatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcvdracatcctggcagattacacgacaaaaagacaggaaaatcagtggaatgagcttcttgaaactctgcaac

SEQ ID NO: 34329 - DNA, 318 bp, Homo sapiens
ttaggttttgggctccgtgtagaccagcagtgatttcaatgcaaaaagacatctcaacagaaggaggaataccaaacacaaatatctgatccacgtaggaatcattttttaaacgaacaaaccccattcatgaaaatgaacacctttcagatcacagtctctggttaagaatcgtgtcagggctaataggcactgttctgatataaatatttgtgccttttggtacaatgggcaccattaatgagtatcattcagcccaatgacctatgcctgcagctccatttctttgtggggctgagattctctgtattacccgtc

SEQ ID NO: 34330 - DNA, 116 bp, Homo sapiens
ctgattataagtaaataggttcactgtaaacgtttggggaaaaaatacttttgaaagttatccttccccccagcaacggtagcactggtgatttgggaatgcattgtggtggtgct

SEQ ID NO: 34331 - DNA, 251 bp, Homo sapiens
  misc_feature 81: r=a or g
  misc_feature 83: r=a or g
  misc_feature 85: s=g or c
agcacagtctccggccaagtagtccgctgccagcaactccagtgtcattaacatttttgcttttctccctttaaccatcargrasgtgcgccactatgcagaaattaccagatacagaaaaatagaagtagaaagatgactcttaatctttccatctggagagaattattgttcagattttgccattttccttccaatcttttttctctgtcctttgttgcttatttgcgttacactgcagatgtcccaac

SEQ ID NO: 34332 - DNA, 395 bp, Homo sapiens
  misc_feature 264: w=a or t
  misc_feature 351: n=a, g, c or t
  misc_feature 353: n=a, g, c or t
atgtgtttctgtctgtataggttaaaatgtcatggaatttgtagcaaactattttgtaacaactgttccaagacaaatataacaatatcaaatactcaagtaataatgaaatatttgctattcaaatatttttacacatatttttgctaataaaagcagacaaaagcagtgttttaaaattaagaatatagtgaactaagagtacaacgacatagtacttgtaagtttttctgatttttttcatatactttaaaatctcttatwttaaactcaaaatctctgttatatacacttttataacatactacaacattgcataattgagccatgtgtgttttaagacaaatattngnggatgttatgttcaataccaatgtctataccatttaaacaat

SEQ ID NO: 34333 - DNA, 206 bp, Homo sapiens
tttcctccttccaccatgtgagaatgcagcaagaaggtgccctgtatgaagcagagggccctcaccaggcaccgaatccggtggcaccttgatgttgaacttctcggccttcagaactgtgacacagagaatgagtggaatactaatacattgaagggcaaaatcaaaaccccagaagatctctaaaagtctgaatgaatcagccc

SEQ ID NO: 34334 - DNA, 452 bp, Homo sapiens
  misc_feature 66: k=g or t
  misc_feature 166: d=a or g or t
  misc_feature 377: d=a or g or t
  misc_feature 381: n=a, g, c or t
  misc_feature 382: k=g or t
ttacgaaaagtcaataattaagcaaattgcttaacacttggttccagttcctgcctatctggagtktaaatgcgtaatacaccattaatttccacgctgcagtttttattttaaagaaagtaacaagatgtctttacactgacactgaaaattcatccattttagdgccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgdtgcnktctgatttttatcagagtgagaaaattaaaattattgatttgcaagtagtaacagttcatattttgattt

SEQ ID NO: 34335 - DNA, 94 bp, Homo sapiens
ctgttttattttctcctattttgataatattagccacacatagggtttctagtttctcaacacctattcttttctttattttagtttcttttct

SEQ ID NO: 34336 - DNA, 350 bp, Homo sapiens
tctattaatattagaagtgctttgtggttttgtttttgtttggttttctaccccttatatcatgaaaaatttcctcccgctttaaaagtctgagtacatagctctcttttagataatgatagttgtgcgggtgaactgcagaatcccattttgctgttataataatatagtacttataagaatataatttgatcctttctgaattttcattaaggagaagtgttgaagttattaacatctagtgagttttctattttgtacattcttctgaaattttgttatttgaaaatttgtcctaatttattaaaatgaatgatacaacattgtgggtgtttacctctgggaagtgt

SEQ ID NO: 34337 - DNA, 107 bp, Homo sapiens
ttgcaggtatgtgccaccacagctggctaattttgttttttgtttgttttttttagtagagatgggggtttctccatgttggtcaggctggtctcgaactcccaacc

SEQ ID NO: 34338 - DNA, 141 bp, Homo sapiens
  misc_feature 14: s=g or c
tggtgtaacccatstctactaaaaatacaaaaattagcctggctaatttttgtatttttagtagagacgaggttttgccatgttggccaggcttgtcttgaacccctggcctcaagtgatctgcccgcctccgcctcccct

SEQ ID NO: 34339 - DNA, 240 bp, Homo sapiens
ttgttttttgagacggaatctggttctgttgcccaggctagagagcagtggagccatctcagctcactgcagcctcctccagggttttcaagtgattctcctgcctcagtctccagagtagctgggactataggcacacaccaccacgcctggctaatttttgtattttaagtagagacagcgtttcaccatgttggccagcctggtctcgaactcctgacctcaagtgatccatccaca

SEQ ID NO: 34340 - DNA, 211 bp, Homo sapiens
tctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccg

SEQ ID NO: 34341 - DNA, 297 bp, Homo sapiens
  misc_feature 177: b=c or g or t
tgaagatgctcttgttttaaacaaggcctctttagacagaggctttgggcgtttccttgtatataaaaatgctaaatgtacgttgaaacgatacaccaatcagacttttgataaagtgatggggcccatgttggatgctgctacaaggaaacctatctggcgacatgaaatcttagbatgcagatggtatttgttctccaggtgagaaagtagaaaacaaacaagtgcttgtaaataagtccatgcccacagtgactcagattcctttggaaggaagtaatgtaccacagcagccac

SEQ ID NO: 34342 - DNA, 186 bp, Homo sapiens
  misc_feature 17: y=c or t
acttctactctcctgcygccatttgaaggacgtgtctgcttccactcctgccgtgattgtcagcttcctgaggtctcctcagccatgctgaactatgaagaaactgaggcactgagaagttaagtaattttcccagggttgtggagttagcaagtagtggagcccagaatcgaaccggcccatctg

SEQ ID NO: 34343 - DNA, 262 bp, Homo sapiens
  misc_feature 207: w=a or t
  misc_feature 209: k=g or t
gctaatacttatatgctacttactatgtactacactgtactaagcatttcatgcttattagatcatttaatcttcaacctaatgagataggtgtatatatatatacagatgaagaaactgaggcgcagagaggctaagtgactggataaaagtcatacagctagtacacggtagggctgtggtttggacccaggcattctggttccwckagactgcactcaggactattaatttttaaaagattgaacacggtagggaaaaa

SEQ ID NO: 34344 - DNA, 245 bp, Homo sapiens
  misc_feature 16: k=g or t
  misc_feature 17: w=a or t
  misc_feature 227: w=a or t
  misc_feature 228: r=a or g
acctaagccgcaggakwtacacccaactgggagatgaggaaacagcaacccagagaggagaactaacccacacaggatcatttcgcgaaggagcaaggctgaagaaccagacctggactttcttaggacaaacttactgcagcttgaaggagccaaccatggatttgaggcgtgtgaaggaatatttctcctggctctactatcaataccaaatcattagctgctgwrctgttttagagcccata

SEQ ID NO: 34345 - DNA, 148 bp, Homo sapiens
  misc_feature 8: w=a or t
  misc_feature 111: b=c or g or t
ccattagwaaacaaactataggtaaatatcacattaatctgtattatcaatttctcatagacactgtgctaatgtgaattttaaatgacctgcatcaagtcttctgatctbagataactcagtacagatagcaattagtcagctgaat

SEQ ID NO: 34346 - DNA, 363 bp, Homo sapiens
  misc_feature 17: n=a, g, c or t
  misc_feature 80: b=c or g or t
  misc_feature 288: h=a or c or t
actttaaggcaggtgcnaacgcaccggcagcaagcttccttttttgcccgggaaaaactgaggtgcaggtagtataagcbattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaahgaccggaatgttcctttcgctgacccagtctctcaccctttccaaactccagaaatcttgtctgtcctcggaaga

SEQ ID NO: 34347 - DNA, 51 bp, Homo sapiens
  misc_feature 18: b=c or g or t
  misc_feature 35: s=g or c
  misc_feature 38: n=a, g, c or t
tctcttcccttttgcggbcatcaccgaagcgggascgnccaaaatgaagtt

SEQ ID NO: 34348 - DNA, 138 bp, Homo sapiens
  misc_feature 84: n=a, g, c or t
  misc_feature 85: k=g or t
  misc_feature 95: r=a or g
agtcccggctgcagcacctgggagaaggcagaccgtgtgagggggcctgtggccccagcgtgctgtggcctccgggagtggganktggaaggcarggagccttccttacacttcgccatgagtttcctgatcgactcc

SEQ ID NO: 34349 - DNA, 215 bp, Homo sapiens
ttttggctattgtgaataatgctgttgtgagcatttgtgtacaggttttgggacatgtttttatttatcttgggttcatactgaggggtggaattgctgacttaacttggtaacctatgtttaacattttgaggaaattctgaattgttttccaaagcagttgatctattttatattcccaccagcaatgtatgtgggttccagtttaggagggg

SEQ ID NO: 34350 - DNA, 163 bp, Homo sapiens
  misc_feature 161: k=g or t
caagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaacktt

SEQ ID NO: 34351 - DNA, 115 bp, Homo sapiens
  misc_feature 2: r=a or g
  misc_feature 61: k=g or t
  misc_feature 79: k=g or t
aractagggatctatctgaaaattcagtaactaatattaggcagttgatactcccccacckcccccatttagatacackactgtattagtgagaatacttggtacagtaacttga

SEQ ID NO: 34352 - DNA, 127 bp, Homo sapiens
  misc_feature 13: k=g or t
ttaaaagaaattkatatctttattaattttttttaaagagaagcttactggaagaacttgtggggagtgctttttgtgcccctaatctgaagttatttatcaaaaccagtctctgattccagcccac

SEQ ID NO: 34353 - DNA, 223 bp, Homo sapiens
  misc_feature 32: s=g or c
agtgtgtgcctcagcgcctggtgcgtgcggastagtgacgggtgggcccggctggggcccgtcattccttcagtgaacatcccatgagctctcgctcggtgttgagccctgtggtaggcacagatgcacccgaccagcacctggagctcaagaagccgcaggaacttaaagaaatggaaaggctgcccttggcaaatgaagataaaacaatgttcgccaacct

SEQ ID NO: 34354 - DNA, 187 bp, Homo sapiens
  misc_feature 11: y=c or t
  misc_feature 30: y=c or t
  misc_feature 61: y=c or t
  misc_feature 129: y=c or t
  misc_feature 164: w=a or t
gcttccatgtyactgtatgtttagaatttycatctaaagttatctcctttttgcacatggytcttcttcctcagttggtgtttggtctctgctgctcagctgaccttggataaaccaacagtccctttycttctgcctagtaagttaatcttagtcttgttggwaggtgtggttaaaggctaattga

SEQ ID NO: 34355 - DNA, 279 bp, Homo sapiens
aattattttaacaactaaatgagattaaatacattaacatgtttaaaatcatttgctgcttgggatgctctaggacgattgaacaggagctttggctcacaagaccggaactgcagtaatctccttccatgaggagttcagctttgtccccataggcacggttcctctggcatttctgctgcttgctctcttggggacggaacccccttaggaagtgtttgaaaactgcaagatctcaccctctccaccaccaagccaagggaaatctgaccaaaagga

SEQ ID NO: 34356 - DNA, 211 bp, Homo sapiens
ttatctaatttaaattcttagttttttctttgtctttctcagctgatacttgtagttttgttttgttttttaaccaccaagaacacttgcaagtttgttactgaaaacatcactaaaggaaaagaagagtttcaaaatgcttgaaaagtagtatgtggttgggaattgtttttgttcaagtccctggaagtcctcttggcttagctcccta

SEQ ID NO: 34357 - DNA, 56 bp, Homo sapiens
aaacttgccgtcgctgcgacggaagcaggaacttgctaaccacacaacatacgagc

SEQ ID NO: 34358 - DNA, 147 bp, Homo sapiens
attatttaatacattatgctatattgtactgtaatacactactttgtagtataattatttggtttcacgagaaaccatttgaatctttatctcattcagcctttatatgacaccagaatgacagtatcatcacaactctagcaaccg

SEQ ID NO: 34359 - DNA, 122 bp, Homo sapiens
cttctatgagaagagtagaggagaggaatgaaggacaggaagaggacggagttgggaggaatggaggaaaaggcattatgttagatagggagaaatctaggctccagcctcagctgtgctgc

SEQ ID NO: 34360 - DNA, 370 bp, Homo sapiens
  misc_feature 2: n=a, g, c or t
cnataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataatgttctgtgtgaaatcagagccgttgtagcctttgaactgaggaggtccatcatctgattaatgtttcctctggctctgtgttggaattaaacggtacattggcaaaggcgaaagcagggagaccaattaggaaggttctccagtagttaattgagagattatggagtcttggactatcatggcagcagtgaaagtgatga

SEQ ID NO: 34361 - DNA, 339 bp, Homo sapiens
gactaagcaattccacttccatctctcaagctgtttacttcctgaaagtagctgtttgatccaaacctgtttatgccagaagttcttgtttaatttactatcaaactaatgaaattaatgcaagacagttgtttatacacaaaccagattgcttgctttggaaagactaaaagggagttgttaaaagaaaaacatgccaggcgtggtggctcacacctgtaattctgcactttgggaagccgaggtgggcagatcacttcaggtcaggagttcaagaccagtctggccaacatggtgaaacaccgtctccactaaaaatacaaaagttaaccggggcgt

SEQ ID NO: 34362 - DNA, 154 bp, Homo sapiens
gtgccaccacacctggctaatttttgtatttttagtagagacggggtttcaccgtgttggccaggatggtctcgatctcctgacctcatgatctgcctgccttggcctcccaagttgctgggattacaggtgtgagccaccgcacccggctaca

SEQ ID NO: 34363 - DNA, 361 bp, Homo sapiens
  misc_feature 73: k=g or t
  misc_feature 92: s=g or c
  misc_feature 96: m=a or c
  misc_feature 111: k=g or t
  misc_feature 292: r=a or g
  misc_feature 327: r=a or g
  misc_feature 337: r=a or g
  misc_feature 356: s=g or c
attcattatactgaaaatgtgcttgttgttgaaaatttgtctgcatgttaatgcctcacccccaaaccctttkctctctcactctctgcctscaamcttcagattgacttkcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagragaaaatgatagcttggctgttctcctgcttaggrcactgactgratagttaaactctcactgscacta

SEQ ID NO: 34364 - DNA, 195 bp, Homo sapiens
  misc_feature 83: s=g or c
  misc_feature 160: n=a, g, c or t
ccgtgaacatggacgagctcaagcaccaggtcatgatcaaccagttcgtgctgacggcgggctgcgcggccgaccaggcgaasaactgctgcaggcggcccactggcagttcgagacagccctcagcgcctttttccaggagaccaacatcccctacagncaccatcaccaccagatgatgtgcacccccgcagt

SEQ ID NO: 34365 - DNA, 230 bp, Homo sapiens
aattaaaaatgaaaaactttttaaaagaatgaatagaacctagtatttgctaacacagcagggtgactatgtccaaaataatttaattatacatcttaaagtaactaaaattataattggattgtttgtaacacaaaggatatcccactaccctgatgtgattattacacattatatgcctgtatcaaaatatgtcatgtgacctgtaaatatagacacctactacacac

SEQ ID NO: 34366 - DNA, 353 bp, Homo sapiens
  misc_feature 264: r=a or g
  misc_feature 265: r=a or g
tattcaaagggatcatagacctaaaagtaaaatgcaaactagaaatgtcctggaatatatcataggagaaaatgtaggttaccttaggtacgatgatagcttataaatttttttcactcatttaattgttaatatctgtgggtacataataggtatttatggggcacatgagatgttttgatacagacatgcaatgtctgtatttttagtagagacagggtttctatgcttttttacaaacaatccaattatactcttttagtrrtttttaatgtacaatttattgactatagtcaccctgttgtactgtcaaatcaaagggcatatttcatctttctaactgtatttttgta

SEQ ID NO: 34367 - DNA, 273 bp, Homo sapiens
  misc_feature 100: s=g or c
gttttttccagctcctgggcgaatcccacatctgtttcaactctccgccgagggcgagcaggagcgagagtgtgtcgaatctgcgagtgaagagggaacsaggggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgcagggtggaagctcggccttcctgtcgcaccaccgcccc

SEQ ID NO: 34368 - DNA, 144 bp, Homo sapiens
aattaccattttaagtgtacagtttagtggcactaagtacaatcactttgtcttgcaaccatcactaccattcatctctagaactttattcatctttccaaaactgaaattccatgttcactaaacaatattctccgctccccc

SEQ ID NO: 34369 - DNA, 135 bp, Homo sapiens
atttctgtaaggtggaggttggggaagaacagagttcacgatcttcaaagctgctgcgggcattctatgtccccttcctgtcagatcagtatacagtgtacgtaaactacaccatcctcaaaccccggaaagcta

SEQ ID NO: 34370 - DNA, 168 bp, Homo sapiens
  misc_feature 51: m=a or c
  misc_feature 132: m=a or c
tttacattattatctggcatagactgttatatatagcatattattgttgamatacaaaacaatatgtatccgtactgtatgtgatatagtgccattttcagtaactgctgtacacacagcaactcagatgamactcaaggaaattcttcagagcaaaaacagccaact

SEQ ID NO: 34371 - DNA, 253 bp, Homo sapiens
  misc_feature 242: y=c or t
ttttctgggatggggtctaactgtgctgcccaggctaaagtgcagtggcgtgatcttggttcactgcaacctctgcctcctgggctcaagcagtcctcccacctcatcctcctgagtaggtcgctgggaccacaagcatgcaccaccacacctggctaattttttgtatttttggtagagacagggtttcaccatgttgctcaggcttgtctcaaactcctgagctcaagcaatttgcctgycttggactgtt

SEQ ID NO: 34372 - DNA, 278 bp, Homo sapiens
  misc_feature 144: s=g or c
  misc_feature 191: y=c or t
  misc_feature 192: w=a or t
atatagagggaattgttcttcaggctcggaggggcctgcctgtcactgcgcccccgaccctagctcagggactgcagaactcaagataccatcccgtttctcctggctgaggaagggaagggaacatccacatcttctgtactsgtccattctgtgtccccggggcctggagtaaagacaccttcaaatgywgagactcttcagattcagctttcctggaaactgatcttcaatgcactaagagaaggagactctcaaaccaaaaatgaccaggaggc

SEQ ID NO: 34373 - DNA, 159 bp, Homo sapiens
  misc_feature 135: s=g or c
  misc_feature 137: r=a or g
  misc_feature 140: r=a or g
cttcaaaatcaaggagattaaatccccagaaatggcagaggattggaatacttttctgctacggttcaatgatttggacttgtgtgtatcagagaatgaaaccctcaagcatctcacaaacgacaccacactccsgraargtacaatgaccagcgggct

SEQ ID NO: 34374 - DNA, 321 bp, Homo sapiens
  misc_feature 136: r=a or g
  misc_feature 142: w=a or t
  misc_feature 144: w=a or t
ccgggaggtggaggttgtagttagccgagatctaaaaaaattttaaaaaaaaagagtggatttggagctacgagacaacagctgaatagctatactctgacataagaatttaatttcttgaaatttattcaatggraattawtwacgaatgtttgtaagtgatgttctccacagcattatttataaagcttgcagtgaaaataataaaaacaactggctgggctcagtgactcacgcctgtaatcccagcactttgggaggctgaggcaggaggatcacctgaggtcaggagttggaggcttagtctggccaaaatggtga

SEQ ID NO: 34375 - DNA, 168 bp, Homo sapiens
tgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaactt

SEQ ID NO: 34376 - DNA, 244 bp, Homo sapiens
  misc_feature 67: k=g or t
agtctgagcccagagagccgcggggaccatggagccggtgccgctgcaggacttcgtgcgcgccttkggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatgga

SEQ ID NO: 34377 - DNA, 139 bp, Homo sapiens
cacattctccggagaccatcaccctaggtacatattcttccaacctttcttctgtgcataatcatctaggtgtggtgcttacattttcttttggcagtgttatcttagtatcttccagcatggttttctcacctgatac

SEQ ID NO: 34378 - DNA, 198 bp, Homo sapiens
ctgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgcctgcctcagccgcctccccagcac

SEQ ID NO: 34379 - DNA, 204 bp, Homo sapiens
  misc_feature 6: m=a or c
  misc_feature 21: r=a or g
  misc_feature 48: s=g or c
  misc_feature 49: w=a or t
tacagmtatacagaaaataaraatcacccataaacccactacccagaswcaggcaccattaacatgggatatcaattgtgaattttagcctatgcacacatattttgtaaatgggatacacaaactgcatactgtttgtatatggtggatttttacttcaactgtgttgtcacatgaatatgaacatctcccttatccgccaac

SEQ ID NO: 34380 - DNA, 262 bp, Homo sapiens
tacagggctgcctcccacccccgtcatatttactggccagtaatgtttctttttctgtgagttgcagttagtcttttctttaaatgttagcaaagtagtacatgcatatagtttagagtcaaaaaaatcctataaagtttacaaaaagggagcccttatctcccttcagtagagacgcaaccttccttttttatttcctgaatattttcaatatgcagttggttgagtccatggatgcaaaacccattgatacggagggtcc

SEQ ID NO: 34381 - DNA, 276 bp, Homo sapiens
  misc_feature 36: w=a or t
  misc_feature 188: y=c or t
  misc_feature 197: y=c or t
  misc_feature 245: w=a or t
  misc_feature 247: w=a or t
  misc_feature 248: y=c or t
tttattcaatcatttacattattatggacacatgawatttgattttatcataatttggattatattctaatagtaccttgtttctttttttaatcaaataatttcagctctggccactggaaactctttcagttgccctgtgtcctttgacacacctgcatcactacagagtttttgataagcatttytttattttytggcattacaacttgcatcactgttatgtatgtgtatatatatatacwcwyacgtatatatatatacacacacgtatat

SEQ ID NO: 34382 - DNA, 171 bp, Homo sapiens
  misc_feature 64: k=g or t
tcttttatcctttttgtttgctggattgatttgtataaatgtatggagtacaagggtaattttkttacatgcatagatgtgtagtggtaaagtcagggcttttagggtatccgtcacccaaataacatgcattgtacccattaagtaattgttcatcatctaccccctccc

SEQ ID NO: 34383 - DNA, 198 bp, Homo sapiens
gatggagctaatgatctcttcagctttgatgagtaccggggtacttggaagttacaactaggtggcgagtctcaagttggattttcgtttgagtggttttacgttgtgtgtagttagcagttgcttcatgggattgttgttgtacctggatctcaggctcagggagcaatgggaagcatgatttttagttggtgccgc

SEQ ID NO: 34384 - DNA, 164 bp, Homo sapiens
aggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctgtagtcccagctactcgggagagt

SEQ ID NO: 34385 - DNA, 338 bp, Homo sapiens
  misc_feature 41: r=a or g
  misc_feature 207: v=a or c or g
  misc_feature 208: s=g or c
  misc_feature 332: s=g or c
tatcaaaatattattttcaaggtttaattttctaataagaraatttttgcttctaatctatttcctttacttttattgttattattattattttgagacagagttttgctcttgttgcccaggctggagtgcaatggcctgatcgtggctcactgcaacctccgcctcccaggttcaagcgattctcctgcctcagcctcccaagtvscagggattacaggcacgcgccatcacacctggctaattttttgtatttttagtagatttggggtttcaccacgttggccaggctggtctctaactcctgatctcatgtgatctgcctgccttgsctccct

SEQ ID NO: 34386 - DNA, 238 bp, Homo sapiens
  misc_feature 15: s=g or c
  misc_feature 16: s=g or c
  misc_feature 19: n=a, g, c or t
  misc_feature 43: s=g or c
  misc_feature 53: k=g or t
gctgggaacgcggassgancgcagtctggccgccattgcgctscggggaaaakccggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcgg

SEQ ID NO: 34387 - DNA, 52 bp, Homo sapiens
gtgattgttttcattgctgctattaccataatacatcaaagctctcctattt

SEQ ID NO: 34388 - DNA, 306 bp, Homo sapiens
attcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcgccaaaatgaagtttaat

SEQ ID NO: 34389 - DNA, 114 bp, Homo sapiens
gcctagggagaaaacgtctgactccagccaccggccttcaaggcacggctttttattccttcggctggtcggcctctcgcccttcagctacctgtgcgtccctccgtcccgccc

SEQ ID NO: 34390 - DNA, 271 bp, Homo sapiens
  misc_feature 48: m=a or c
  misc_feature 51: k=g or t
  misc_feature 53: k=g or t
  misc_feature 67: w=a or t
  misc_feature 68: d=a or g or t
  misc_feature 71: k=g or t
  misc_feature 84: k=g or t
  misc_feature 231: r=a or g
aaaaataaagatcgttacaggcaggtttcactcaactgctgtttgtamtgkckgtctttcacattcwdatkccagatttatatkttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccraatcccaatgccttgtgactttcataggattcctgatcat

SEQ ID NO: 34391 - DNA, 245 bp, Homo sapiens
caaaggttgagagaaaagtggccagaattgtacatataacagagaataccttgaagaattagtagcaaaatactgtaaataatattcatttcctcagggaaaaataaagggcatgcaaaaataggtctggagactcctgaaactaggaagaattttgttatcactaaagtcttttatagtcagaacaatttttttttcaaatgaacatggtatcatttcaagacaaatttatgtgaactgggcgc

SEQ ID NO: 34392 - DNA, 217 bp, Homo sapiens
  misc_feature 207: r=a or g
tttaacaatttgaaaaattattctttaatgtataaagtaattttatgtaaattaataaatcataaatttcatttccacattgattaaagctgctgtatagatttagggtgcaggacttaataatagtatagttattgtttgtttttaagaaaagctcagttctagagacatactattactttaggactgtgtagttgtatatttgtragatgacgcc

SEQ ID NO: 34393 - DNA, 357 bp, Homo sapiens
  misc_feature 224: r=a or g
  misc_feature 237: r=a or g
  misc_feature 327: r=a or g
  misc_feature 337: r=a or g
caaaataaaattaataaagatgcaaagaaaatgcgagttttcatactctgtatgtttttattactgtagtatgaggtatgttatttggaaagcactgtttcaattacaaatatttgacactcttaattatattgtcaccttacatgtaggaattcgtcttttataagttgaaattgtcatctacaaagacagtttctttttacggattttgaaaaacataagartttaaataaagaractttagtatattcttcagctgctcttttctcttagtatctaagcttgttaaaattgctggatagttcaattaagatcttttacagtgaraattgtgtarttttgactgtcctgaaacca

SEQ ID NO: 34394 - DNA, 354 bp, Homo sapiens
  misc_feature 58: k=g or t
  misc_feature 66: k=g or t
  misc_feature 258: r=a or g
  misc_feature 263: v=a or c or g
  misc_feature 265: r=a or g
  misc_feature 267: v=a or c or g
  misc_feature 271: n=a, g, c or t
  misc_feature 274: r=a or g
  misc_feature 288: r=a or g
  misc_feature 297: r=a or g
  misc_feature 299: r=a or g
  misc_feature 325: r=a or g
  misc_feature 329: r=a or g
tggtcatttgctacttggattttcttgtccaattaatagtgacatttgacattgtatktagtcttktccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaraagtvaravtagngcrataaagtaacagarttccttttrarcccatagtaagctcttctggcatgartttrtagccctcttctacccttccagcca

SEQ ID NO: 34395 - DNA, 168 bp, Homo sapiens
gttgcttgcaaaattccacccagaagataagggagggagtatcgctgcagcgtcctgctctgtgcctggttatattactggatccttgtgttgcagccctaagatagaaggattgtctccatttcacagatgagagagactgatgcgcaggaggctgaaattgtctga

SEQ ID NO: 34396 - DNA, 284 bp, Homo sapiens
  misc_feature 198: b=c or g or t
  misc_feature 210: b=c or g or t
  misc_feature 212: s=g or c
  misc_feature 218: r=a or g
  misc_feature 251: r=a or g
aaatgggacatgctgcctagtgttggaggtagtcaccaatacttacctcctgcctcctccctggttccaggggtactgctggacattaaactaagccaaagtggggatataagcaggaaggtaaaagggttgataaggaaaaagctatatgagggtggaggagggcagagttgacacctgaggagaggaacctgcagbcgggctcctctbasgctgtrggggaaacaagtttaacaggacttagccctgarggaacaacagttgctgaaatgggcggcggagtt

SEQ ID NO: 34397 - DNA, 237 bp, Homo sapiens
attgccgaagtgagccgaagtttgtggccccgcttccggagaactcaagctcccgattgtgcccgaaggaacccgaaggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggaccttt

SEQ ID NO: 34398 - DNA, 154 bp, Homo sapiens
taggattggctttagctcaggtggttacttccttactttccatctgtctaatccctgtgcttgggttcaagacctgccggggctttctgacctttaaataaaaaacctaaaagacattattagcttgttttttgattttggttttttttttttt

SEQ ID NO: 34399 - DNA, 237 bp, Homo sapiens
  misc_feature 134: n=a, g, c or t
  misc_feature 232: k=g or t
tacaaagaaacaagtaaatgggatgtcgtgcatgtatgcacatgctcacacgtgtataaatcagtgtccatttaaaaaatattaacatttaggtaaatagagtattacatattatactctttagatgatcaagnctctaatctgtgttgacacttcagaatttattaaaagatcttcccttacttttcagtaatttaattagtttctttaagcctgacataacgaggaggaktccca

SEQ ID NO: 34400 - DNA, 129 bp, Homo sapiens
  misc_feature 50: y=c or t
  misc_feature 51: b=c or g or t
  misc_feature 52: y=c or t
  misc_feature 53: s=g or c
  misc_feature 63: k=g or t
gctaactgcgcaccgcggccatgacgctgggcagatcattcacagaagtybystgtctccttkcatctacagtcgcagctgttttccagacgccttgctcctcaggtcggggagtgatctgatggccct

SEQ ID NO: 34401 - DNA, 198 bp, Homo sapiens
  misc_feature 108: b=c or g or t
gcatgcgcaaccggttctccgaaacatggagtcctgtaggcaaggtcttacctgaatcaggatgagggagtggtgggtccaggtggggctgctggccgtgcccctgcbtgctgcgtacctgcacatcccaccccctcagctctcccctgcccttcactcatggaagtcttcaggcaagtttttcacttacaagggcct

SEQ ID NO: 34402 - DNA, 404 bp, Homo sapiens
  misc_feature 240: r=a or g
  misc_feature 244: r=a or g
  misc_feature 294: r=a or g
ataaggtacagaactttccaaaaggcgagttgctctaccacaaaagggatgaccatatggcttccatcctgggctgacatcttagcaggttgaaggagaagacccctaggaacgcgcaccaaacccataatagtagctatataacctccccagcgttttctgccatgtggttcctcagctgggaagataaatccccaccaaaatcaatcaggggtgccttccaaattctggtgacctgaracaragctataactgtagcaattaaccaaaaacatgcacccaatttagggagaragttttggatacacagccaatctattagccatctcttcccaaggcaggtggtgacttgagaactctgtgcctggtttctgaggactgtttcaccatgcagtggctaatga

SEQ ID NO: 34403 - DNA, 276 bp, Homo sapiens
  misc_feature 55: v=a or c or g
  misc_feature 77: m=a or c
  misc_feature 111: y=c or t
  misc_feature 234: r=a or g
aacctgatggggtcccttttcaagctgtggaacctttgttctttctctgtttgcvaataaatcttgccactgctcamtctttgggtccacactgcttttatgagctgtaayactcaccgcgaaggtccgcagcttcactcctgaagccagcgagaccacgagcctactgggaggaacgaacaactcccgacgcgccgccttaagagctgtaacactcaccgcgaaggtctgcarcttcactcctgagccagcgagaccacgaacccaccagaagga

SEQ ID NO: 34404 - DNA, 351 bp, Homo sapiens
acacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacctgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctc

SEQ ID NO: 34405 - DNA, 148 bp, Homo sapiens
tattctattttccttacacaccttgcatgtaaaactgttcttcagttatctcaagtaggtgttacagtgttaacgcttagcagcttttacttttggtgaaaaccttggtaagtttgggattcaaattatgtactgagcgtggagctgc

SEQ ID NO: 34406 - DNA, 304 bp, Homo sapiens
  misc_feature 287: w=a or t
gtatgtgtgatttgattttatttgccctttgaactatgacccaatactccccaaacctgttattcagtttttgcccagagttattatatctggggaataaacagaggacacacacccagaggctgccagtagcaaaaatcactgtaattcaaaaagcatgacactacggtagtgaaattatcacacttttctttgcatagagcagtttacttgtgatgattttcaaagatgtgttctcccacttgtcaggttcatctcttcaactgtgtgtcgcacaatttctcgawctcagtgctgttgacat

SEQ ID NO: 34407 - DNA, 248 bp, Homo sapiens
  misc_feature 211: m=a or c
accagaatttcatttctctttattgctgtgtagtaagtgatctgttttatgaatatacatggtttctttcacttgtccacatacgtactattaggaataaagcagaacattattgtatgaggccttttgtgggcatatgtttttatttctcttgagtaaatacctaggattggaatcactgggtaataggataggtgcaactttataagamacagctagagctttttgtactgttttacctgaccacc

SEQ ID NO: 34408 - DNA, 367 bp, Homo sapiens
  misc_feature 283: n=a, g, c or t
aagactgctgtgctagcaatcagtgagactccgtgggcgtaggaccctccgagccaggtgccggatataatctcgtggtgcgccgttttttaagccggtctgaaaagcgcaatattcgggtgggagtgacccgattttccagtacatgaatcactcctactaagagatcctgaaagaggtcatcaaagccaccagaaactattcctggacagaggaggttttataggtgtggttggtctccttactgacgtgtcaactacaaatgcacagggttctgcctganatgttttagttgttgcagatgtgtagcttctatatgtaaagtcttcactgcacgtgctacagaaacttgaactatctgaagaga

SEQ ID NO: 34409 - DNA, 199 bp, Homo sapiens
  misc_feature 34: m=a or c
  misc_feature 99: m=a or c
ttgagagggtggatgggttacttgcccaccagamacagccctagtcccaactccttgcgttcctttggcccctccctgcctacctagaatctgcctgamaggctggagaggggcagtattgggggactgtgctagctttacccccgcaggacatacacaggagcctttgatctcattaaagagatgtgaaccagcgttc

SEQ ID NO: 34410 - DNA, 323 bp, Homo sapiens
  misc_feature 72: w=a or t
  misc_feature 290: n=a, g, c or t
acctggaaatactgatgataacatattaccttatttgaacaagttttcctttattgagtaccaagccaatgwaatggtaacttggactttaataaaagggaaatgagtttgaactgaaattaggtatttgtttcatgtgtttgcattaataagcagaaagttaagtgctgtattggtttcatggttttgctgccctcttacatgctgagagaactgtgttaattctctggaaaccatctgacatgaaaatcagcttcattaatatgtttgggtgccctagcttgtaaatnagctgaaggctagaagtcatttatatagaattt

SEQ ID NO: 34411 - DNA, 174 bp, Homo sapiens
  misc_feature 9: y=c or t
  misc_feature 14: y=c or t
  misc_feature 19: y=c or t
  misc_feature 49: y=c or t
  misc_feature 75: m=a or c
ggtgttgtyttgtyttgtyattttggacaacataaaattcaggaatgtyttatttagccttggtttctagaaggmagggaaataatatttcttgagcatttactagggtgttgcgtgctgtgctaagtaaattttaagtctttcagttttatagatacggaaaacaagggtggc

SEQ ID NO: 34412 - DNA, 193 bp, Homo sapiens
caaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaaggta

SEQ ID NO: 34413 - DNA, 84 bp, Homo sapiens
  misc_feature 31: h=a or c or t
  misc_feature 32: b=c or g or t
  misc_feature 59: m=a or c
actctgccccacagccacagcccctgactghbgcagcccccacagagcccgccgcgcamccccacgtcccccacgccagcgccc

SEQ ID NO: 34414 - DNA, 235 bp, Homo sapiens
  misc_feature 71: r=a or g
acagcagcagatactgtgatttttgttgacagtgactttaatcctcagaatgacttgcaagcagctgccarggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgcca

SEQ ID NO: 34415 - DNA, 131 bp, Homo sapiens
aagtagccgaagcggctggagcgggcggcaaggcgaggcgaaagctgcacagggccctacgcggccgcctcagcatgtcggacttcgacgagttcgagcggcagctcaacgagaataaacaagagcgggac

SEQ ID NO: 34416 - DNA, 175 bp, Homo sapiens
acctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggca

SEQ ID NO: 34417 - DNA, 236 bp, Homo sapiens
ccttcatttcaatcttggtgaatctgacgattatgtgtcttggggttgctcttcttgaggaacatctttgtggtgttctctgtatttcctgaatttgaatgttggcctgtcttgctaggctggggaagctctcctggataatatcctgaagaattttccaacttggttccattctccctatcactttcaggtacaccaatgaaacgtaggtttggtcttttcacatagtcccaata

SEQ ID NO: 34418 - DNA, 366 bp, Homo sapiens
cgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgttttgctttttgacaactgcttctcccacgttccttgcaattctattctctcaccttcactttactatttgtattcgatggaccaggataattcaggcaaggttaccttgtaaacttgaattggccacacaccatgttgtcaccctct

SEQ ID NO: 34419 - DNA, 391 bp, Homo sapiens
  misc_feature 231: w=a or t
  misc_feature 351: r=a or g
acattgccttcttgcagacggtcagcaggcagcgcctccaggacttttcccagggctcccctgcttgcttgtttctggccatctgcccaacattcttacgtgtcttatggtaacattagggctaatagtgaaccattcaatgaatgacgttgtttctaccccagaaatactctcacagtggtagggaagatataacttctgcttatttcttagtaatgagggcagtaggawatatcaaagcattgaggagatttagagaaggaaattatatctcacttctctttgggggtgatcaggaaagacctcaaagagaaagtagcatttaatgtggaccttgaaggatgattagargttttgtcagatggtggaggtgaaacactccatcttaagc

SEQ ID NO: 34420 - DNA, 212 bp, Homo sapiens
  misc_feature 102: n=a, g, c or t
  misc_feature 155: r=a or g
  misc_feature 179: r=a or g
  misc_feature 188: n=a, g, c or t
  misc_feature 192: r=a or g
gaacaggcaacttacagaatgggagaaaatttttgcaatctactcatctgacaaagggttaatatccagaatctacaatgaactccaacaaatttacaaganaaaaacaaccccatcaaaaagtgggcaaaggatatgaacagacacttctcaaragaagacatttatacagccaaaaracacatganaaartgctcatttcactggccaca

SEQ ID NO: 34421 - DNA, 117 bp, Homo sapiens
  misc_feature 54: r=a or g
  misc_feature 82: r=a or g
  misc_feature 95: m=a or c
  misc_feature 96: m=a or c
tttggttttatcagccacattttatgggttattaaaatagcacctgtgatgggrtgagcaaaaagaaaatggcatgggtgarggagcagcacctmmacccttacctcatccgagaat

SEQ ID NO: 34422 - DNA, 290 bp, Homo sapiens
  misc_feature 287: d=a or g or t
  misc_feature 288: n=a, g, c or t
  misc_feature 289: s=g or c
  misc_feature 290: h=a or c or t
ttgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaadnsh

SEQ ID NO: 34423 - DNA, 256 bp, Homo sapiens
attatagtttcataacactgttatgttttaatgcctactagagctaagtctagatgaaacaaaaaagtatagaattaaaaggtcgatctgtgatgtaccatttgaagaaaattccacaggtttctgtgactgattcccttagccaaatgctacacttgtttgctgaatttatcacttaaccttattttatttgagtctgttttgaggaattaaaatggttctactcattgttggcatgacctcctctcccctcccc

SEQ ID NO: 34424 - DNA, 226 bp, Homo sapiens
aaaacctcaggcaacgtgagagcattagagcattcatccagatgcaggaaagtggaactgctggtgagagatggggcctggatgtgtttgcttaggctgtgtgaaacacctggtcttaagcgatcctctcaccctggcctcccaaagcattgggattacagggagaaaagaatgggaactgtgaggaaaagaatgacatgaacaatgggaagaccaaggtcccaga

SEQ ID NO: 34425 - DNA, 246 bp, Homo sapiens
tgtaatcccaaagtgctaggattacaggtgtgaaccaccgtgcccggccctactttctatcgaagtagaataggtagatcacattattattaacagtatatgggaagagggaggtcctcccatgttacattgttctcccttcaccttctcggtcatgttgcaccactgtttcccttctagtcatatcccagggggccttgtcccatttatacagctctattctagtggtcaccagaggaatgggag

SEQ ID NO: 34426 - DNA, 423 bp, Homo sapiens
  misc_feature 93: m=a or c
  misc_feature 94: k=g or t
  misc_feature 98: r=a or g
  misc_feature 106: y=c or t
  misc_feature 110: k=g or t
  misc_feature 121: b=c or g or t
  misc_feature 299: n=a, g, c or t
agggatacaagacactgcagactcccgagagacataacacagaattgcaccatgccaaactacaaactcacttattttaatatgagggggagmkcagraattaatycgtkacatatttgcbtatttggacatacagtatgaagaccacagaatagaacaagctgactggcctgaaatcaaatcaactctcccatttggaaaaatccccattttggaagttgatggacttactcttcaccagagcctagcaatagcaagatatttgaccaaaaacacagatttggctggaaacacagaantggaacaatgtcatgttgatgctattgtggacactctggatgatttcatgtcatgttttccttgggcagagaaaaagcaagatgtgaagagcagaatgttcaatgagctgctcacgtataatgc

SEQ ID NO: 34427 - DNA, 329 bp, Homo sapiens
  misc_feature 107: m=a or c
gagtcccgggctcagtatgtggcgccttcctcgcgcgctgtgtgtgcacgctgcaaagaccagcaagctctctggaccttggagcaggcctgccgccttcatgtccmactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagaa

SEQ ID NO: 34428 - DNA, 216 bp, Homo sapiens
  misc_feature 118: y=c or t
cctgtaaaatcttggggagaatgggattgcagccctcagcctaaagattgtgatttgccagtctctagtctctgtcttccaaggttgagagaggtgggaggtctctgaaaatcatccygttagagtgtctgtcctcttacagtgcgagagaaggaacgtttctcagggtttcagctcacacgaaaacacagcaggattcttttcactgcagcgggg

SEQ ID NO: 34429 - DNA, 208 bp, Homo sapiens
  misc_feature 40: n=a, g, c or t
atcccttcatcttgctgctgggattgtggatataacaggngccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttc

SEQ ID NO: 34430 - DNA, 71 bp, Homo sapiens
  misc_feature 11: k=g or t
gatatcttgakccagtacctggaaaaggaggactgctttttttactcactggtgtttgaccccgtgcagaa

SEQ ID NO: 34431 - DNA, 227 bp, Homo sapiens
  misc_feature 84: w=a or t
  misc_feature 92: s=g or c
  misc_feature 113: r=a or g
aaaaacccaacaacaacccagaacaaagcaaaacccagcagactgtacttagcattgtctaaatccattctcaaattccaaatwtcacagasacccctcacacaaggaatatraaaaccaccaccctccagcctgggcaacgtagtaaaacctcatctatacaagaatttaaaaataagctgggcgtggtggtacacacctgtggtcccagctactagggaggcaat

SEQ ID NO: 34432 - DNA, 51 bp, Homo sapiens
  misc_feature 21: v=a or c or g
  misc_feature 23: r=a or g
  misc_feature 25: v=a or c or g
atcgcggtgggggtgtgtgtvaravagattgggggtgttcgggcagtgtaa

SEQ ID NO: 34433 - DNA, 290 bp, Homo sapiens
  misc_feature 71: s=g or c
tgactaaaaacagttttttatttgtgtgctgcattatgctgttctcacagtagtgagcaatgattgcgcascctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccaca

SEQ ID NO: 34434 - DNA, 364 bp, Homo sapiens
ccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttaataatagggaca

SEQ ID NO: 34435 - DNA, 251 bp, Homo sapiens
  misc_feature 69: y=c or t
  misc_feature 78: y=c or t
  misc_feature 91: m=a or c
  misc_feature 105: m=a or c
  misc_feature 158: m=a or c
  misc_feature 171: m=a or c
  misc_feature 180: m=a or c
  misc_feature 219: m=a or c
  misc_feature 234: y=c or t
  misc_feature 235: v=a or c or g
ttagaatatgtatcatttgctaatctgataagcaaaatggtttttaataataataacgtaatctatttyataattatycctgtcatatttmcttttcagattgtmactgttttgcttacatctaagcaacttgtacactaaattttaaattaatagamcaacagtaatgamatgataggmggttggagggaaaagcaatttctctctaaaatgatagtmatgtaaatgcttttyvagtagacattgttgat

SEQ ID NO: 34436 - DNA, 136 bp, Homo sapiens
cagggcctggaacgcctgtgcggggaggtcactcaattcaaaattttctgtatgaaagcatttttcaccaaaatgagcctcatccctttatgcaacacataaccttactgagggagggaaatacggaagccaccgt

SEQ ID NO: 34437 - DNA, 305 bp, Homo sapiens
gaaggtagagccgaccctgtctcctgatggctggttacagctacaagaggacaaggagagtccagagcctgggcctggtcctgagagaaggttgctacccacgtgttgagagaatgtgcgtgcgccacctcagctgcgccccgtggacattagcgaatgtttgaggagtgagttattcagtagatggagagaggccctcaaagttggctagaagataaatgactaaaaggaaagcctgtttttctcattcttaggtggtgaagaaggtgaagtccatgcagatgttccacatgcccatcacttca

SEQ ID NO: 34438 - DNA, 114 bp, Homo sapiens
  misc_feature 27: b=c or g or t
ttccacaaaaccaccattgtcatcatbgcccatctccaatgagccgctgggcacacctcccagacggggtcgtggccgggcagaggggctcctcacttcccagtaggggcggcc

SEQ ID NO: 34439 - DNA, 327 bp, Homo sapiens
agatgcagctttgataggttttgcttttattttatttattttattttattttttcactttcgttgctcaggctggagtgcaatggcgcgatctcagctcactgcaacctccgcctcccgggttcaaacaattcttctgcctcagcctcccaactagctgggattacaggcatgtgtcaccatggccggctaatttcgtattcttagtagagatggggtttcaccatgttggtgaggctggtctccaactcctgacctcaggtgatcaggccacctcagcctcccaaagtggtgggattacaggcgtgagccaccgcacccggccctc

SEQ ID NO: 34440 - DNA, 391 bp, Homo sapiens
  misc_feature 30: k=g or t
aactagcacacagccagcattaggaggcaktagtagaggtaaatgacagtctcttctgaaaattttaatgctttgcttttgtatctgaaaatttcactggaattgatttcttgtgtgtagtatgagataggaatcccatttcactttttacatggcatttccccaaaggatcatttattgaatagtccatcttttccctactggtttgaaatgccaccactgttaaagatcacatttatgtttatatgtgttgatcagtttctaagcactgtatagtatcttattggtctgagtttttaaaaaatcaatgcattattttaaatcaaaacttcattaactctttaaacttatttagcttaatcttactattttgttgaataatactccctcc

SEQ ID NO: 34441 - DNA, 290 bp, Homo sapiens
ttaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctc

SEQ ID NO: 34442 - DNA, 347 bp, Homo sapiens
  misc_feature 215: k=g or t
gcacttattagtctttcagatatcaccttttgtcagaactcagagttatgacgggccctcaccatactgaggctttctgactgagctcctctctaccctggatacaagagaccctaataggcaggaatatcattgcccctagtcagcctaaagaagttacagtggatggatctttgcccctctgcaacccttaggattaaagatccccttgtaakacggaggggggaaatatgtcagaagtgtttgaaccagagcaactgcatcttgaacagggtctgggtaaaataaagctgagacctgctgggctgcattcccagattaggcattcttagttgcaggatgagata

SEQ ID NO: 34443 - DNA, 331 bp, Homo sapiens
aacctgatggggtcccttttcaagctgtggaacctttgttctttctctgtttgcaataaatcttgccactgctcactctttgggtccacactgcttttatgagctgtaacactcaccgcgaaggtccgcagcttcactcctgaagccagcgagaccacgagcctactgggaggaacgaacaactcccgacgcgccgccttaagagctgtaacactcaccgcgaaggtctgcagcttcactcctgagccagcgagaccacgaacccaccagaaggaaaaaactccgaacacatctgaacatcagaagcaacaaactccggacacgccgcgaa

SEQ ID NO: 34444 - DNA, 311 bp, Homo sapiens
  misc_feature 229: m=a or c
ccgggaggtggaggttgtagttagccgagatctaaaaaaattttaaaaaaaaagagtggatttggagctacgagacaacagctgaatagctatactctgacataagaatttaatttcttgaaatttattcaatggaaataattacgaatgtttgtaagtgatgttctccacagcattatttataaagcttgcagtgaaaataataaaaacaactggctgggctcagtgmctcacgcctgtaatcccagcactttgggaggctgaggcaggaggatcacctgaggtcaggagttggaggcttagtctggcca

SEQ ID NO: 34445 - DNA, 113 bp, Homo sapiens
ttatattgtcatagtggtttttattcctgctttgtttctggaaaggaaatcctgaattacttaagtactttgtgtttaatatatctgggtgatggatcacaacacatcaatca

SEQ ID NO: 34446 - DNA, 252 bp, Homo sapiens
ttttccctgtggcatataagctctgggtctggccagtaacagagtgggttatacctgtcttgcagccatccgagatcacgcttctgtcttgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggaatgg

SEQ ID NO: 34447 - DNA, 281 bp, Homo sapiens
  misc_feature 278: v=a or c or g
  misc_feature 279: h=a or c or t
  misc_feature 280: k=g or t
  misc_feature 281: k=g or t
atagccacttttaacgtctttagtactttatagccttgcaaatcttttcctatgcatgtattttggattttggttttatggtacttttggtggtccttttacaaaaatggatccctttatacatgttttctgaaactattactttataatagaaacaacacataccaacataacatgaacatatatcatcacttttacatgactgcttcatattcatcagtatttggcagctgtttgtgaatactgccacatgttttttaagatgtataaagggagcvhkk

SEQ ID NO: 34448 - DNA, 139 bp, Homo sapiens
atttgtaagaatattatatatagatgatcatctgttatgatattccttgtgcacatatgttggtttgtcctactattggtgatattaagtttgatcacttgatgaagtggtatccatcagatttctctactgaaaggct

SEQ ID NO: 34449 - DNA, 152 bp, Homo sapiens
tgaaatgtaagatcagttttatcttttgtttctgatttttgaacacctcaaattgatgaaggataacttcttaaaaatgtcttattttagtcctagtgattttgaaaaatataatcagtttccttaatttttccgtcttttctaggtgtcat

SEQ ID NO: 34450 - DNA, 158 bp, Homo sapiens
attcccaataataattgaccacagacagccgcggttcgcgtccacctggcgcttctcagcaggagctggacctgtttctccgtcgggccggctctcgggctgctgttgcgcctggtgttttccacgcttccccggcgcgggactgtggggcccctgca

SEQ ID NO: 34451 - DNA, 220 bp, Homo sapiens
ctgtcggtctaagaagggcactcttgatgaatgcttcttagttgtttgtgagggttgtggcttaaagtagctaagctttataattctgttggctctatcaaatgaaaagtctatccattccaaaactgaacaaataagttttatttctgtgtgagaacaaatggttacttggaatttactgggatttttctttttccaaatccacatagtactggcaaca

SEQ ID NO: 34452 - DNA, 80 bp, Homo sapiens
ttgggtttattgtctcttttatatgtgcatgcatagtccattttacctctcacatcctgtatttgtctggttttttcttt

SEQ ID NO: 34453 - DNA, 66 bp, Homo sapiens
cgagatggtgccattgctctcgtttgggcaacaagagtgaaactcttgtctcaaaaaaaaaaaaaa

SEQ ID NO: 34454 - DNA, 258 bp, Homo sapiens
  misc_feature 143: n=a, g, c or t
  misc_feature 144: n=a, g, c or t
ctttataataatttttaaattattcataactatcctaagcaataccttttattgttagattattatgtaatgcccacaaatgatagatagcatttgaaagtaattgctggctgattataggcatggtggcttatgcctataannccagcactttgggaggccagggttggtggatcacatgaggccaggagttcaagaccagcctggccaacgtggcaaaactctgtctctactaaaaatacaaaataattagctgga

SEQ ID NO: 34455 - DNA, 352 bp, Homo sapiens
  misc_feature 190: d=a or g or t
actcagctggggaaaactcaccctgaggacttgaaattgtgtccagaactggtgggttcttggtctcactcacttcaagaatgaagccgcggaccctcgcagtgagtgttacagttcttaaaggcggcgtgtccggagtttgttgcttctgatgttcagatgtgttcggagttttttccttctggtgggdtcgtggtctcgctggctcaggagtgaagctgcagaccttcgcggtgagtgttacagctcttaaggcggcgcgtcgggagttgttcgttcctcccagtaggttcgtggtctcgctggcttcaggagtgaagctgcggaccttcgcggtgagtgttacagctca

SEQ ID NO: 34456 - DNA, 376 bp, Homo sapiens
  misc_feature 108: d=a or g or t
  misc_feature 109: w=a or t
  misc_feature 115: w=a or t
  misc_feature 116: w=a or t
  misc_feature 118: s=g or c
  misc_feature 120: k=g or t
  misc_feature 277: r=a or g
taattagaaaattgatcaatgtttctttctcatatgagcagaatttcttctgtagtcctgtgtgcacaagatacatgtcaattgactattttttgtcatatgtaacadwcagatwwtsckgcctttcactttagagctacctcaaaaacattgttacaggctaggcacagtggctcatgcctgtaatcatagcactttgggagaccaaggctggagaatagcttgagcccaggagttcaagaccagtctgggcgatataaagagaccctgtctctaraaaaatttaaaaattagccaggcattgtggcatgcacctgtagttctagcttgagcccagcaggtggaggctacactgagccaagatcacaccactgcg

SEQ ID NO: 34457 - DNA, 113 bp, Homo sapiens
aacctgatggggtcccttttcaagctgtggaacctttgttctttctctgtttgcaataaatcttgccactgctcactctttgggtccacactgcttttatgagctgtaacact

SEQ ID NO: 34458 - DNA, 187 bp, Homo sapiens
attatttatgtggcagggcagatattgtggttactgaaatggcttttaaacccgactcaactatttcatttcaagtgtgctgttctgtcattttctctaacgtgggaagctcagctgcgtaacttgtagtaacgaagcggaagttacaacgaaaagacaagttttcctgtgcttcgcaggccccccc

SEQ ID NO: 34459 - DNA, 401 bp, Homo sapiens
agcggagttgaggcagaagccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacaggtactggccaggaatacctccctcctgagcttgatgaaggctagtggggcagagtcccagactctctcacctgtttatgccctggttttttaaattctacaatttcagagtcttcacagcctgcactgcaaacctctttccccattgctacccctactggtcatcagct

SEQ ID NO: 34460 - DNA, 89 bp, Homo sapiens
acgcctgtaatctcagcactttgggaggccgaggcaggaagatcacttgagcccgcaagtttgagaccaccctgggcaacatagcgagc

SEQ ID NO: 34461 - DNA, 319 bp, Homo sapiens
  misc_feature 290: n=a, g, c or t
  misc_feature 292: n=a, g, c or t
  misc_feature 293: b=c or g or t
gagacttcgcttgggcttcaggctaccgcgttaatgtgtacttgcctcgcttcttatagctgtgtgttgggccagtgttattattgatcgcttactgtatatcccaggcccactttccagcatctgaatccgacgaatcaattaaattaaccagaagttttggtgctttggttgtttttgagacggagtctcgctctgtcgcccaggctggagtgcagtagcagcaatctcggctcactgcaacctccgcctccctggttcaagtaattttcctgcctcagcctttccangnbctgggactacaggcgccaacccccac

SEQ ID NO: 34462 - DNA, 208 bp, Homo sapiens
  misc_feature 43: k=g or t
aaaagcattgatgacttagaagagaaagtggctcatgccaaakaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcaca

SEQ ID NO: 34463 - DNA, 173 bp, Homo sapiens
attctgtccccgacccaggctgaaatctcgccctggccacgcttccccagcgccggagtccacacctgctctgcgctctggctacacatctcctgtcgctgccacgcgcctgcacgctaacttgccgacgcctctgccctccgcctgctccaccatctttgttacgccccctc

SEQ ID NO: 34464 - DNA, 68 bp, Homo sapiens
  misc_feature 39: s=g or c
aatccgcagttcccgggccagcctggggcggccggccasgaaccacccgttaaggtgtcttctcttta

SEQ ID NO: 34465 - DNA, 332 bp, Homo sapiens
caaggtgttagatgaatttgaacaaaacgaagatgaaacagtttcttctactttattggatacaaagtggaataagattctagatcccccttctcaccggctgtcatttaaccctactttggccaagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggtg

SEQ ID NO: 34466 - DNA, 349 bp, Homo sapiens
  misc_feature 305: w=a or t
  misc_feature 307: r=a or g
  misc_feature 308: s=g or c
gacaaaatatatgactgccaaggtttactgccacctccagagaagctcactgccgagtcctggagcagaacaattcttccccgaatacaagaacgcagaaagcacgtccttgtggccattgtcctgaggagtggattacatattccaacagttgttactacattggtaaggaaagaagaacttgggaagagagtttgcaggcctgtgcttcaaagaactcttctagtctgctttctatagataatgaagaagaaatgaaatttctggccagcattttaccttcctcatggattggtgtgtttcgwarsagcagtcatcatccatgggtgacaataaatggtttggcttt

SEQ ID NO: 34467 - DNA, 325 bp, Homo sapiens
  misc_feature 79: k=g or t
  misc_feature 80: w=a or t
  misc_feature 93: h=a or c or t
  misc_feature 96: w=a or t
  misc_feature 97: k=g or t
  misc_feature 116: w=a or t
  misc_feature 241: m=a or c
  misc_feature 259: w=a or t
  misc_feature 260: m=a or c
  misc_feature 261: n=a, g, c or t
  misc_feature 299: w=a or t
attgcgttttcccatatgacatcttatcttacattatttgcatattgtattacattatctcttctcttatatattagakwagtgactggagthatwkttatttcctctgcaagagwgctatagttcgagatcatgtcttagagttggttacttctgagaagagttcttatatttggctaattccactgtacatatattatcagtatctagaaatttcggttggcctctttcatcaagccamattctgattcaattttcwmngaaacttaggcagtttctacactattcagaaagctggwgggggaggccatctagggtagattta

SEQ ID NO: 34468 - DNA, 170 bp, Homo sapiens
tcaaaaccaagtttcagtttcctaaagtcacacacctaatagcagagtcaggatttgaactcaattccgtgtctttcaatggcagaaggggttttgcacattagattacataagccattgtccattgactccttgtcctttgcacttgtccaagagtggtccccaggcaa

SEQ ID NO: 34469 - DNA, 384 bp, Homo sapiens
taactgtgaaatgatgatggttctccctaacgtctcctcaaaggatacaagaaagttgttgttgctagtagaccgaggggtgggaattactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaatattctcaccttcagagtataagaagaatcattcttaaagccaaatattcagttcaaggcacatacgtcatctgcagttgtaaatttgcatttaatatttcacaattcctgtaagaga

SEQ ID NO: 34470 - DNA, 219 bp, Homo sapiens
  misc_feature 84: m=a or c
  misc_feature 93: y=c or t
  misc_feature 162: m=a or c
  misc_feature 214: m=a or c
aaaaaacactagggaggaggccacctggagcccaccctcccaacaagaagcccagaggacgccggcatttggggctagccctgmacccccacytccagcccggagacccaaaggcagctctgatccagtcaggcccttgttgcagtgcagtgcaggacagcmagcccccagccaggatggcaccaagagcccccgccccacctccatgaccgcmaggac

SEQ ID NO: 34471 - DNA, 488 bp, Homo sapiens
  misc_feature 487: k=g or t
  misc_feature 488: r=a or g
ataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggacagtgagtgtcagtgtcagatctagaaggctkr

SEQ ID NO: 34472 - DNA, 410 bp, Homo sapiens
  misc_feature 381: n=a, g, c or t
  misc_feature 382: k=g or t
  misc_feature 383: n=a, g, c or t
tgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctanknctccaaagcattgggatacaggcatca

SEQ ID NO: 34473 - DNA, 229 bp, Homo sapiens
gtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggc

SEQ ID NO: 34474 - DNA, 282 bp, Homo sapiens
gttaaatgtctatctgtgcttgcctcaatgtgcctccagtgctgatagagaacaggttaaacaggtccggtgttcacatctaaaatgacctggagaggactgggcgcggtggctcatgcctgtaatcccagcactttgggaggccaaggtgggaggatcgcctgaggtcggaagttcgggaccagcctgaccaacatggagaaactccatctctactaaaaaatacaaaattggctgggcatggtgttgcatgcctgtggtcccagctgctcgggaggccgc

SEQ ID NO: 34475 - DNA, 193 bp, Homo sapiens
gagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcg

SEQ ID NO: 34476 - DNA, 172 bp, Homo sapiens
caggtctaaaaccaaccaagcacattgaatattttgaaaaataaaatcaagaggttgaattccagccaccttgtttggggtgatatgaaaacatccagctctcctggtgagggcctctcccaccccatgccatcatctggaggcgggctgctccgcccaccatggcccctta

SEQ ID NO: 34477 - DNA, 171 bp, Homo sapiens
aaaagaagaactggcgggactcgagtgtggccgtgtcagacgtggcaagaaaaaccagcagttgccttttcatctcttttctgatgatctaaccatgaaagtccccagtatttgagcatttaaggcagaatgtaaattcataatttaagaagattttttgttacgtggcca

SEQ ID NO: 34478 - DNA, 412 bp, Homo sapiens
  misc_feature 164: r=a or g
  misc_feature 377: m=a or c
  misc_feature 386: r=a or g
agacacggagcaggaatgtgaatcacccaacgtcatgctctcacagctggggcaggatgacaatgcagcgtggaccacttggtgctacagacgaggcttctctatggagtgacagtcatcgcttatgtcctcagtcaccagtgtggaattaagagagtggtagrattcacttaaacaggcgagcatttcttggaaaaatactgatacaggtctgagaccctctgatttttcttggaatccccaggagttagcaaaatctgtgcagcagccattgcatcttctagcaggaaagtttctaccaaagacctttcaagtatcaacatatgaagaagaagaaagaaactggctgttaccgatctcacagtctttctgatggmcaaaagtgrcaaagcatgaagactgaagacgacag

SEQ ID NO: 34479 - DNA, 144 bp, Homo sapiens
  misc_feature 34: s=g or c
  misc_feature 35: s=g or c
gatatttgggagcggccccgagacgcgcctggcssgatcctaaatcccgacagctttatagagcccaggcctggcaggctcccagaacttgaagccaccagaccccacatggaaccaaaggcctcctgtccagctgctgcaccg

SEQ ID NO: 34480 - DNA, 164 bp, Homo sapiens
taatatatttgacaagatctctttttattatgtgtttaaataagggttaccatttttaaaaattgtgtttcctgggactcagaggctttgaaaaatttttggaaatatatcttccattctcttacctaatcacttttttttgacattaatatttgtgtggcata

SEQ ID NO: 34481 - DNA, 212 bp, Homo sapiens
  misc_feature 93: r=a or g
tagctaaaagcaaatcggcttgtttctcagatctttgggggatagcaagaaacatttgagtgaatgttgttgaagattttcagtagtatagaraaatgatggcgctcttgtgatatttgtaagtagtaagtaaaatttactttttgtgtacaaatctttgaagtttttgttgtgttgagaactttttgattgtagcacgttaaggctgatcg

SEQ ID NO: 34482 - DNA, 276 bp, Homo sapiens
  misc_feature 162: y=c or t
agaccaacaaccaggtgtgtggagggcctctgccttccctggcctgtgctgggtctggaggggccgcagaaacacggcagatggagacagcagtcaccactgtggacacacacctctcgggagacagtgaagccttctcacatcgctgtcctgcctggtgaytcaaaatccagacacacagctgtctttatgagtccctgtttcactgctgaagaggctgaggccgagaggatcggccaaggggcctcaggcaggagcagcagagctccggtgcac

SEQ ID NO: 34483 - DNA, 379 bp, Homo sapiens
  misc_feature 235: d=a or g or t
  misc_feature 324: r=a or g
  misc_feature 330: b=c or g or t
agaagccatatttccccggagtccccgagtggacgtcccagaggagttccctgccgagtcccgttacctggcaggtgacatcagcgtgactgcatgcttcttctgcaccctcacggtgcagggatggtgatgcgtgcgactccgggcaattaatgtggtgattttaaactcaataataatatagccatgtttgtcctcgaatggcagagatgccagtcattgcagcataaggctdcccagtttccagttttatttacttagtagccaggctgaaatgtggaatcctagagaataaggcagatttattcttcatagcgacaaggraactcbacatgcgaaggagaaaaaattccggtttgaactcaacaggtgctgatga

SEQ ID NO: 34484 - DNA, 158 bp, Homo sapiens
  misc_feature 96: r=a or g
agtgacttctggctctacagtctgcgctcctgctggagctggcagagaccagagctgccaccgctgctgcttccaggagtgtgcaggtggcagctrccgctgagcccgcggcggaggatggcagggcttgttccagaaggcttgagggtccccgagct

SEQ ID NO: 34485 - DNA, 157 bp, Homo sapiens
gaaggaacacaagactccggaagcatgccagcgtataaaaccgtcaggagcaatggctgacgcctgtaatcccagcattttgggggcctaatcgggcagattgcttgatgccaggagttcgagaccagcctggccaacacgacactttgcctcactt

SEQ ID NO: 34486 - DNA, 382 bp, Homo sapiens
cggtctcttcccttacaatatggtaaacatgtaaacaaagtgtctacaaaatccattacagatgctgctatagcagtatgtgccggcacagggccatccatgaggttgtttttgcaatgaagtggaggaggtgaggaagcacacttccagcattgcttgttaaagccttagggctagggttccatgattgagagtttattttagtacactagcatagtatttaggagagtgctaactgctataacaaagagacccccacataggcaaatacccaagcgagataagttattttctcctgatgtcacagttaagagcaggttaaggcagaagttcccctccacgaattaattcacccaggctgatagctgttctgccatcttca

SEQ ID NO: 34487 - DNA, 86 bp, Homo sapiens
aattgaaagaaaaaaaacccattctccatggtcactaacagaaacgtcttgctaaatcctcttgcttatttgagggctgtggtcca

SEQ ID NO: 34488 - DNA, 395 bp, Homo sapiens
agcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctatta

SEQ ID NO: 34489 - DNA, 157 bp, Homo sapiens
gaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccta

SEQ ID NO: 34490 - DNA, 270 bp, Homo sapiens
  misc_feature 89: s=g or c
  misc_feature 91: m=a or c
  misc_feature 103: s=g or c
aaagctctttccagaggatctccagcgagtaaacgcagaaggagtgatgggatccgaagatcaccgttttgcaaaccttcaggaaacgscmagaaggggggasgtctggacaccgtgtggagacagctgtgggatgcatctgcacactgaggagccatgatggctgtgggacgcccagaagctgggggaggcctggagcagcctctcccttacagcctcagggggaatcagcctgctgtgagataataaatgtctgttgtttaagccccc

SEQ ID NO: 34491 - DNA, 254 bp, Homo sapiens
  misc_feature 97: n=a, g, c or t
aggaaacgatgggcttctctgtgcgactgccagcggcctctggcggctcattccgcgcagatctgcgtggcgcccgagccctcccagtgggcccccnaaggctccacgcgaccgagtattcttcttcccttggcctcgctctctgcccagccccgggctccttttctccacacgtggctgtcaagcgccttctgtatgccccacactcctgggagcttgggctacatcgatgaacaaaaacaaaggacagggag

SEQ ID NO: 34492 - DNA, 131 bp, Homo sapiens
gagacggagtctcgctctgttgcccaggctggagtgcagtggtgtgacctcagctcactgcaacctccacctcctgggttcaagcgattctcctgcctcagcatcccgagtacaggcactacaggcacacc

SEQ ID NO: 34493 - DNA, 83 bp, Homo sapiens
ttcttttaaaactctcagtgtaactgtatcccgtgacatttcattttttttaaatagtgtattttttttccattttttttttt

SEQ ID NO: 34494 - DNA, 146 bp, Homo sapiens
atttcagctcaataaaacatcaccaaattcccttaggcagaaaaagggtggggagtgccctttcttgaaggaatcccttaagtgcacgtctccccgttttcttttcacatcaatgcagagtccctctgtgaatttacaacacccgc

SEQ ID NO: 34495 - DNA, 144 bp, Homo sapiens
aaaatgatgtcactgggaactgcagtcatttgaaaagatagcaatcaagcatttctttcagagccctgttcatctttcagtggctttgcttctcctgatgcttttgctccttcaattatctctgccttctcccacctcctctcc

SEQ ID NO: 34496 - DNA, 291 bp, Homo sapiens
  misc_feature 91: y=c or t
  misc_feature 168: m=a or c
  misc_feature 191: y=c or t
  misc_feature 194: y=c or t
  misc_feature 198: y=c or t
  misc_feature 205: k=g or t
  misc_feature 207: k=g or t
  misc_feature 260: y=c or t
ataagtggtcaggcattttagtgttgcactaactggtctctgccttcttggtttattgccaagtttccagccctggggtatccttgttatytactttcctcctgcaccaaagctcggaagcgttacactatgtactcattcattctcacttttactcctttcttagamataatttcctagagtccaggtgyggygtcytatatckgkaatcccagcactttgggaggctgaggcaggttgattgcctgagcccaagagtytgagaccagtctgggcaacatggcaaaaccc

SEQ ID NO: 34497 - DNA, 385 bp, Homo sapiens
  misc_feature 347: n=a, g, c or t
tagcgtctaatggtcggggctggttatacaatttgtgggatacagtgtgaatgaaaatgaaatgcaggcctttgttcaaaaagcaaggggaaaagtacagttaagagtgctaatgtttaaagcttttttcctttgggaagaaaaacatggtagagttaatagcaataaataagtaaacacaaattcaaaattatgtttgtgggtatcatgcttttataaaagatagtaaataaataataccttatcactgtgaaatcttgattaatcatgactttctggctcttttttctgcaaattcattttagtcatcaaaatttatacttttataaagtttcatttttaattantatattggaagtaatgtcaattatgtttggcaaatgca

SEQ ID NO: 34498 - DNA, 168 bp, Homo sapiens
gaggacgtgagggcgcggccggtggaggatgtgtgggcgcggtgctggtacttttacaatgcttcgtgaacctgctgtccgtagctctgtttcacagatgggggaaactgaggcctggcgattaagtggcctgctgaaatcatccagctatgacatattcgatgccct

SEQ ID NO: 34499 - DNA, 60 bp, Homo sapiens
  misc_feature 47: m=a or c
aaactgcggcggtttacgcggcgttaagacttcgtagggttagcgamattgaggtttctt

SEQ ID NO: 34500 - DNA, 242 bp, Homo sapiens
ttctcttttgtgaaggcagttttgctaagagtatgggtctggaggggctctgatgggtgagctggctgccttctccttaggccattgtggcccctaaagcccagccagcttcatcctctctgctttggcgaggaggtgctgatgtagccaggaggggaggggttaggaaatgaagtggccagtaccccacgatcccactgcagttgagtttgtcccctccaatgaggtggaccctgggccct

SEQ ID NO: 34501 - DNA, 191 bp, Homo sapiens
ctctttacggcccacctcagcgctgcccgcgcgaaatttgtatccctctgcttgtgtccactggctcctggggagcagcgcagggaggaggaggaggaagatatcaaagagccctcccattgggggccccagatcgccacttccggtgaccagagattacgtgtgaaaatgaacttgtgcaaacccaaccc

SEQ ID NO: 34502 - DNA, 168 bp, Homo sapiens
  misc_feature 40: w=a or t
  misc_feature 41: w=a or t
actaccttgtcgggtagaggagtgtggagcaagaaaaggwwagagaaggtgacaggggatcctggagctgtgctgtggcttgaggagatccgccagggagtggtcagagccaaccaggacactaatacagctcagagaagctcattggcggggttataggcagcaggt

SEQ ID NO: 34503 - DNA, 385 bp, Homo sapiens
  misc_feature 233: r=a or g
  misc_feature 354: r=a or g
  misc_feature 355: r=a or g
  misc_feature 356: r=a or g
  misc_feature 358: r=a or g
  misc_feature 378: r=a or g
cacatttcaatactaacattagatgtaaatggcctaaatgctccacttaaaagatgcagagctgcagaatggataaaaagtcacgaaccaaccatctgctgccttcaggagactcacctaacatataaggcctcacataagtttaaagtaaaggggtggaaaaaggcatttcatgcaaatggacaccaaaagcgagcaggagtagctattttatcagacaaaacaaacttgaragcaacagcacttaagagagatgaagagggacattacataatggtaaaagccttgtccaacaggaaaatatcacaatcctaaacagatatgcacctaacactggagcacccacatttagarrrcrattactaatagacctaggaratgagat

SEQ ID NO: 34504 - DNA, 191 bp, Homo sapiens
  misc_feature 42: n=a, g, c or t
  misc_feature 43: m=a or c
  misc_feature 54: b=c or g or t
acatgatctacattggggcctgggattatttttttaattttnmgtttgcatgabatagcctaataaatggaggtggggccaggcatggtggctcacacgtgtaatcccaacactttgggaggctgaggaggaaggatagcttgaggccaggagtttgagactagactgggcaacatagcaagaccccgccg

SEQ ID NO: 34505 - DNA, 158 bp, Homo sapiens
  misc_feature 59: k=g or t
actcagtagtcagaaattaagatcccctctgatagagatagattctcaaaaccaaaatkggactgaaaattagattgagaagaaagatacaacttcctccatagccaataaaatctgtctttccaagtctgcttattaatgctgtgaatcgctccttc

SEQ ID NO: 34506 - DNA, 277 bp, Homo sapiens
  misc_feature 34: y=c or t
  misc_feature 36: n=a, g, c or t
  misc_feature 41: k=g or t
  misc_feature 44: m=a or c
  misc_feature 61: r=a or g
  misc_feature 62: r=a or g
  misc_feature 79: s=g or c
  misc_feature 80: h=a or c or t
  misc_feature 110: k=g or t
  misc_feature 115: m=a or c
  misc_feature 163: k=g or t
  misc_feature 215: m=a or c
  misc_feature 228: m=a or c
caaaattacctctgttattagccggatgcctgtyancattkacmtggaaaattcacagaarrtaacctttgggcaaaashagctcctcaaaccctcactggtctggtgakcgcamtcactggcctggtgaacgtttccctggtcccggtgaatgccctgaaakgccccgtgaagggctcagtgaccacactgaaaagtttggtgagcacccctgmtgggcccgtgaamgtcctgaaagggcctgtgaatgttcttacggggccagtgaatgttctca

SEQ ID NO: 34507 - DNA, 111 bp, Homo sapiens
  misc_feature 23: k=g or t
agctccctggctgaagatacatkccgagtcagcacatgggtagagatgatgtaaaagcagccaatctggaaacaatacattgtaaatagtttttcattgtatgaagtagtg

SEQ ID NO: 34508 - DNA, 353 bp, Homo sapiens
cacattaggcgaacaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggttgt

SEQ ID NO: 34509 - DNA, 241 bp, Homo sapiens
  misc_feature 108: s=g or c
  misc_feature 114: k=g or t
  misc_feature 124: m=a or c
cacaaatgtgaaaagatgcttgatctcactgataaagcataaattaaaacgatgtcatttttaaaaatcagattcgcaaattttaaaagttgctaacactggaatggscagagkaagagggaamcgtgacacaggcacagattgctggtagacatataagttggtacagccctctctatgtaattttgtgtttgtcaaaattacaaatatgtatgcccttaacccaggaattccactccct

SEQ ID NO: 34510 - DNA, 162 bp, Homo sapiens
  misc_feature 157: k=g or t
  misc_feature 158: k=g or t
aactggagggggattttcctttaaaaagccttcacaatttttttcaagtaaaatgctctctcccatcagactactggaaaaccatggagctcctgtctatgccatcaaacaagataccaatttttttttctttttccagcaattttctgcttcctakkccac

SEQ ID NO: 34511 - DNA, 408 bp, Homo sapiens
  misc_feature 316: n=a, g, c or t
ctgggatgacagttgtggtatgcatgatagtttgtcgttgttttttggctttttttcatctcaaagttattccatctctaatttagatcaacaacagatcaatcagtggattgataatggtgggtagtataaaatcatcagagctgaaggcatctagaaattatctgtaccagccctctgctttagtcatggaaaatagtcagtatactcatttttatagacagtgtatctcaggctcagagagagaatgtgacaacaaacaataaactcagactttgtctttaaggctcagtagaatctttcatttcttagtctntttatttcttggtgtgatttttttctgacagtttcttgtatggagtattttcttcttccttttacattttcttaatgcatatatattcacat

SEQ ID NO: 34512 - DNA, 75 bp, Homo sapiens
tcacaacttccttcctgctttcctcccccaagcctccgcctttctccctcctccctcctccactacccccccccc

SEQ ID NO: 34513 - DNA, 235 bp, Homo sapiens
  misc_feature 117: r=a or g
  misc_feature 119: k=g or t
  misc_feature 120: k=g or t
  misc_feature 132: m=a or c
  misc_feature 141: r=a or g
  misc_feature 145: k=g or t
  misc_feature 165: m=a or c
  misc_feature 167: r=a or g
  misc_feature 172: b=c or g or t
  misc_feature 178: s=g or c
  misc_feature 185: s=g or c
  misc_feature 203: r=a or g
  misc_feature 205: r=a or g
  misc_feature 211: k=g or t
  misc_feature 221: y=c or t
gacgaacggaagatggcggcggcggcggcggcggcagtgtaggaagaggcactgctgagggggcgcgaggggaacggaggccagagctgctctgacagcagccatggcgagcggcartkkagacagcgtcamccgtcggarcgtkgcatcacagtttttcactcmaraggabgggccsggcatcsatggcatgaccacctcararagggtkgtggatcttytgaaccaggcggca

SEQ ID NO: 34514 - DNA, 309 bp, Homo sapiens
  misc_feature 98: s=g or c
  misc_feature 99: r=a or g
  misc_feature 100: w=a or t
  misc_feature 101: r=a or g
  misc_feature 112: r=a or g
  misc_feature 195: h=a or c or t
  misc_feature 200: h=a or c or t
  misc_feature 210: y=c or t
  misc_feature 211: s=g or c
  misc_feature 244: h=a or c or t
  misc_feature 270: y=c or t
  misc_feature 271: v=a or c or g
  misc_feature 279: s=g or c
acacagctggcacggctgatgcggcggaacagcctgaaccgcaaggcacgcagaggcccgcatcaatgcccagctgcccctgacagacaaggccccgsrwrggcccgccatrtcctagacaactcgggcgagtggagtgtcaccaaacgccaggtcatcctcttgcacactgagctggagcgctccctggagtahctgchgctgaggttysgggtcctcacagggctcgctgccattgccagchtcctctacctgctcacccactacctyvtgccttasgcctagtggggcactcaaggcagggagccc

SEQ ID NO: 34515 - DNA, 51 bp, Homo sapiens
taaaacagtatagtcataacacagatatggcagttttttagtttttttttt

SEQ ID NO: 34516 - DNA, 291 bp, Homo sapiens
tactttcgtcagcctgttgtctcttatcttcatgttaggtatgactctatttttattttactagtctgctcacagacttctttgggacttatgttatattttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccac

SEQ ID NO: 34517 - DNA, 73 bp, Homo sapiens
attttttaagtggagtctcatagtttgactgaatggaataatttccattggcattgcaaaaaaaaaaaaaaaa

SEQ ID NO: 34518 - DNA, 329 bp, Homo sapiens
  misc_feature 285: s=g or c
  misc_feature 287: s=g or c
attatctatctgtatgagagaaaaggggaggaggactgctgaaaaaagggacgggttaagggttttgcactatagtttagctcttccagcagaacgcggcgctgtcaagctgtcaatgtctgtctaccgcctcggagacacaggccgccgggaaaccacagggtcgacgggaacggcggagtgtagcatccccgggccccaagtccacagtgcctctcccacttgacctgtcggcgccccttctcaaagtacggatctccaagaggaaggacctcctccctctcsastctcagagtaaagcaagccagcagcgcaaagtgcacctcccg

SEQ ID NO: 34519 - DNA, 369 bp, Homo sapiens
  misc_feature 89: r=a or g
  misc_feature 221: w=a or t
  misc_feature 222: n=a, g, c or t
  misc_feature 339: r=a or g
ccggccgccgcctgccctctccgctggccacctgctgccgcccgcgccatggctggcaaagcacacaggctgagcgctgaggagagggraccagctgctgccaaacctgagggctgtggggtggaatgagctggaaggccgtgatgccatcttcaagcagtttcatttcaaagacttcaacagggcctttgggttcatgacaagagtggccctgcaggctwngaaactggaccaccatcctgaatggtttaacgtgtacaacaaggtccacatcacgctgagcacccatgagtgtgccggcctttcagaacgggacataaacctggccagcttcatcgracaagtagcagtgtccatgacatagaccct

SEQ ID NO: 34520 - DNA, 162 bp, Homo sapiens
catgctattttttctacctcctctgctcttctgccctctttatttaggcaacttctactcatccttcagatcccaggtcaagcatatccttcttcagggaaggtttgcttgacatcgctgatggggtcaaatcctccttttagaggctatcaccacacgcta

SEQ ID NO: 34521 - DNA, 414 bp, Homo sapiens
gagttggggtaagagtggggtgttcctgccagccccaggagaggggaaagcaagcccccgtccacccttgtgggtctctgctcctggaaaaggtgctctagcaggctcatctgtgtgagtcactgtcttccatgtgggcccctgcccatctgagcagcagagttcatcccataccctgcagggagtccagcgccaccatgatgtccctctcttccctccttgaggctggctgggtccagcctgagctgtgccacctgctggctcaggccagtgggattgtgcctcaggcaggctcctgcccttccaagccaagggcttggctgcagacccgacagcggctcccagagaatgctggaagccaagcttgcacattctaggcagccatttgaagattcttctctgcacatgaccagc

SEQ ID NO: 34522 - DNA, 241 bp, Homo sapiens
  misc_feature 198: r=a or g
tttctggttctagatccttaaggaatcaccatactgtcttccacaatggttgaactaatttacattcccaccaacagtgtaaaagtgttcctatttctcctatctcttgccagcatctgtcattttttgactttttactcattctgactggcgtgagatggtatctcattgtggttttgatttgcatttctccaaggrtcagtgatgttgagcttgaacgctttcttaattggtggctgct

SEQ ID NO: 34523 - DNA, 237 bp, Homo sapiens
tgtaatcttcccagatccaaggtaataaaatgcgtggacattggaaccatgctgcaactatgttgaactcttcttggagcatgtcaggtgttccaagaacacacgttattcatccaagctttgaataaattcgtggttttgtggtatagtagacagtcctggctctggaatcaaaaaggcttagtctagaatcctgcctcccctatgatgttaaccttaggcctccctaacccccga

SEQ ID NO: 34524 - DNA, 225 bp, Homo sapiens
  misc_feature 20: s=g or c
tgttccgttagatcgcgcascccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgatc

SEQ ID NO: 34525 - DNA, 126 bp, Homo sapiens
gaatagacagggctgctggggactgttgtacaggctgtgcactgctcaagggtatccagagcccagctttggtatctaccaggaagaaggggctcccctcccctcccttcctcttccctccccatc

SEQ ID NO: 34526 - DNA, 211 bp, Homo sapiens
  misc_feature 85: m=a or c
tgattttggtttggtctaaactgcaaaagtgtgtgtgtgccctttttacctgttttttgttttgtggtgtgtgtgtggtgtgaamtggtgttttgtcttgaagaagcatgggtcaggcaaaaataagcccaccccactaggaactatgttaaaaaaaataaaaatttcaagaaagaatttaagggagattacgatgttactgtgacaccaa

SEQ ID NO: 34527 - DNA, 210 bp, Homo sapiens
  misc_feature 17: s=g or c
  misc_feature 80: n=a, g, c or t
  misc_feature 86: y=c or t
  misc_feature 98: m=a or c
  misc_feature 112: n=a, g, c or t
  misc_feature 113: n=a, g, c or t
  misc_feature 114: n=a, g, c or t
  misc_feature 118: m=a or c
  misc_feature 142: s=g or c
  misc_feature 143: w=a or t
  misc_feature 183: m=a or c
  misc_feature 195: s=g or c
  misc_feature 197: k=g or t
tgtgccgggcgccagascagcggcgccagagcagctgcaccatcccggcgttcgcgtgtgccgccgctttcctcctccanctcttytcctccgcctcmgccggcgcgatggnnnacgmctgacggacagcgagaagcggaaswgatcagcgtgcgcggcctggcggggctaggcgacgtggcmgaggtgcggaasakcttcaaccgacaa

SEQ ID NO: 34528 - DNA, 347 bp, Homo sapiens
  misc_feature 113: v=a or c or g
  misc_feature 114: s=g or c
  misc_feature 117: k=g or t
  misc_feature 123: s=g or c
  misc_feature 127: r=a or g
gaattagaacttctcagttctatggtcattccctaggtataagattcagctccccatcccctgcccctgtaaattggagataagtacgtctgcttacctaaacattcttcagvsggkttttgscacrgtcaccttcagctatgcataatagagaattatggaatttttaagggctctacaaatagaaccccctctgcatgagctctccactccttagtaaggaccaggatttgtgggaaccacagtcaataggttgtactacagctgacaacacaatcaactgacagaaaccattactgagtaaacatttacggagcatttgttatatctcagtcactttactaggt

SEQ ID NO: 34529 - DNA, 359 bp, Homo sapiens
attctgggaatggaaagaaggcctctccaggcttcgttgcccccagcgacccaaaagtccgatttccccgccttgattctccccacttcccaatacaggcgtctggctccgcagcagaacacgaagtttgcattccccaaggggcggccagggggcggaccagggaaagtccgccccaggtcagcgacttacaactcttcattctgaagtgcgtgtagtgcccttgtctccagagacgcagagagtcctcgaggccccttgagctaagtgcagcctggcccagtttctcctgccctactctactcccctccctataagcgacccaccctcaaggggcggagggcgcgtagggatgcgct

SEQ ID NO: 34530 - DNA, 281 bp, Homo sapiens
agttagcgagcagctagggtggagtcggcctcaaaggttccgctctcatgtcggcaagtgtgatttgaattttaaaacactgagctttgccggtggaagagttcccaagtttattccgacctacggaaagcccaggaggaccaggattaccgctgccgctggatgcgtccagggccgggatgcgcgaccgtgagacgctgcgcttccgaagccctcgcaggcttccgggtgccagagcaggagacataccctctgtccagccttccactctcagcccccgc

SEQ ID NO: 34531 - DNA, 366 bp, Homo sapiens
cagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagcg

SEQ ID NO: 34532 - DNA, 223 bp, Homo sapiens
  misc_feature 138: n=a, g, c or t
  misc_feature 139: n=a, g, c or t
gcgaacagcgatcgcccagcaccaagtccgcttccaggctttcgatttctttgcctccatcttgggtgcgccttcccggcgtctaggggagcgaaggctgaggtggcagcggcaggagagtccggccgcgacaggacnngtgctgatggcagagattggtgaggatttggataaatctgatgtgtcctcattaattttcctcatgaaggattacatgagccga

SEQ ID NO: 34533 - DNA, 243 bp, Homo sapiens
caaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccc

SEQ ID NO: 34534 - DNA, 149 bp, Homo sapiens
ctaaactggtattctgctcacatctcagcatttagcataaagcatgttggagatgaccttagttttgtgttttcagaagatagaaatattcatgtatatcacagtagaacttaaatgcagtgtgatttaaaacatctcatttgttctgc

SEQ ID NO: 34535 - DNA, 141 bp, Homo sapiens
ctattcaaccataaggtaagattctcataaaccttttataaccctttacactttttgttaaagagcagattcatgctccaagaaaactgttgtgcttttattccagtattcaatttatggaaaaactgaataatacccctt

SEQ ID NO: 34536 - DNA, 211 bp, Homo sapiens
  misc_feature 121: m=a or c
  misc_feature 128: k=g or t
cactaaaataagatcatgttttaattgtgagaaacagggccaagcacagtggctcacgcctgtaataccagcaccttagaggtcgaggcaggcggatcacttgaggtcaggagttcaagamcagcctkggccaatatggtgaaacccagtctctactaaaaatacaaaaattagctaggcatgatggcgcatgcctataatcccagctact

SEQ ID NO: 34537 - DNA, 250 bp, Homo sapiens
  misc_feature 125: k=g or t
  misc_feature 129: b=c or g or t
  misc_feature 135: r=a or g
  misc_feature 220: k=g or t
tatttagaaaccaagatttgggtgctgtaggtgctcattcatatggtgtgttattgcttccagttggtcctttttattatccattcatttggatacaatggtgagggcgccactgaagaaagtgkggcbtagggratggaaagggggaaaggagccagatgacctaggtagagactcccctctccccctctagctctccaggtcttccccactttctctktcctccctttccctcttcatcatgacctcc

SEQ ID NO: 34538 - DNA, 213 bp, Homo sapiens
  misc_feature 129: d=a or g or t
cccttaattttaaaaggttttaatcattcttctataaaatacatttaaaatggaaaaatacttaatatcactaaatatcagaacaatgtaacatttacaaatgacatattgaaagcaaaaggctgtttdatttagccaagatgattaccattaggagttactttatgtattgttgaaagcaaattttaaacatgatgttttagaagtgtttcg

SEQ ID NO: 34539 - DNA, 447 bp, Homo sapiens
  misc_feature 88: b=c or g or t
  misc_feature 120: r=a or g
  misc_feature 123: r=a or g
  misc_feature 125: v=a or c or g
  misc_feature 130: r=a or g
  misc_feature 238: y=c or t
  misc_feature 239: w=a or t
  misc_feature 258: s=g or c
  misc_feature 259: n=a, g, c or t
  misc_feature 260: n=a, g, c or t
  misc_feature 261: n=a, g, c or t
  misc_feature 350: y=c or t
tgactcgtgcctacgggccccaaacagcccaatttggtgcactaaaagcctcatttttagactctgggtccagagtgaggctttttcbagaaaaaaacaaacaaacaaacaaacaaacaracravcaaaraacctacttcagggaaatgacaacaacagaaagccaccatttgccctaaaatttttattgtaaaaactattctctcctgtttgagtagtgagggatctaggacataaywgtggcttctctggctttcsnnnggaatcagggcacttggaaactcaattaaatgtacccaagcctcttaagcaccaaggctatctttttgctcatccagttaatttcagtytgtaaaattggccttgtgctgacatgatggagacggggtgagggtggggaagccagggtcctctgtgagcggatgcttgcttctctgttcacaagct

SEQ ID NO: 34540 - DNA, 399 bp, Homo sapiens
tctgggtaacaagattgacataagcgaacggcaggtgtctacagaagaagcccaagcttggtgcagggacaacggcgactatccttattttgaaacaagtgcaaaagatgccacaaatgttggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacata

SEQ ID NO: 34541 - DNA, 397 bp, Homo sapiens
  misc_feature 79: m=a or c
  misc_feature 80: y=c or t
  misc_feature 288: w=a or t
  misc_feature 289: r=a or g
  misc_feature 361: s=g or c
gtgagaagagccgcgcttgcagcgtctgggagaatctttcggtctccgcgagaggtgcttcattccgtgagtccgagtmyagagaggggccccagccgcgggcctgcgtccctcccgggagccgggtttccgcccctgaggcctcgggctgtgcgctcagttaagcccgaagctgctgtttcctccggtgtccgggccccgcgcccctgtcatcctcactctgtcgtcctcaccctgtcgccctcacccggggcgattctgcgccccaggggacttttggctatagtwrgagacggtttgggatgtcacaaaatggagggtaggagggactgtgctactactgtaatctagagggtggagscagggatgctagcagctcagcatcctgcagcgcgta

SEQ ID NO: 34542 - DNA, 136 bp, Homo sapiens
catttatgattttgtgtggcacacactggtatattattaaattttatacttcattattgttgtggaaccacataagactcactgtgttttcattttgaaaagaaggctaatcagtttttatagttaagtggctgac

SEQ ID NO: 34543 - DNA, 382 bp, Homo sapiens
  misc_feature 6: s=g or c
  misc_feature 124: m=a or c
  misc_feature 125: y=c or t
  misc_feature 131: r=a or g
  misc_feature 144: r=a or g
  misc_feature 260: s=g or c
  misc_feature 261: m=a or c
  misc_feature 326: m=a or c
  misc_feature 327: w=a or t
  misc_feature 337: m=a or c
acaggstgctagtggctggtaaagcacagcagacctctccctggaagggtgcattttgaggtgaccagcatcctcatttgcccagggctttgcaggtaaaggatgcgttcctaggatgtgagamyttaaargtgcctaaaatcrgaaaactctcaggcattttgacaggaaccacaagtctgaggtccccaggaataaactgtcatggttagatggtagaactctgcatcagagaaagggtgtgtgtgtgtgagcgtgasmgtgtgtgtgtgttgcaccaatatgtgcatgtgggtgtatgtgtgcgcatctgcacccatttgtgmwtgtgtgagtmgtgagagtttgtgtatgcatgggtgtgtgacttgttcaagtgtgt

SEQ ID NO: 34544 - DNA, 95 bp, Homo sapiens
  misc_feature 1: r=a or g
rcttaaagcatttaactgaaaggaccttggaaatccttttaaaggaggatgggggtggaaatgcacaggttgcttctctctctctctctcttttt

SEQ ID NO: 34545 - DNA, 264 bp, Homo sapiens
  misc_feature 111: r=a or g
  misc_feature 126: r=a or g
tgtgaggtcaccctcaaactgcaccgccggccagataccctcctgaccccgaggacttggtctggtctctctggtggctacaaccccagagttttaaggacttggaaaggraagcacaatcagagraggaaaacagcccccgaaccagcaggagtggcctggcacatggaccggcctgagcgatgtgcactccacccaagccaggctcccagggggcctgatttctctctcactgtctctttttttaaaatggttgcacggccc

SEQ ID NO: 34546 - DNA, 232 bp, Homo sapiens
taatcaaaatgttcccaaaaggaaaacatcaggcctaggtagtttaactctcagatttatcaaacatttagaaaaaaaataataatcttaaaacattcttccataaaaacagaggtagagaaagcgcttctcaatttactttgtgaggccatcaaaactgtcatataaaatctgatgaacacatcaaaacaaagaaaattaaacatcaatatccatcatgaatgggggcacc

SEQ ID NO: 34547 - DNA, 217 bp, Homo sapiens
ctaaaaccatagaataggaacaaatgtacctgtcatattaataaaagtaaacttatctgtagataaaaggcaaaaatgtcagcaaacactaatttcatgttataagattcagaaaggttgagcaaaagtaaaccaagcaaacacaaacaagaaaatgagttgtagtctgcatatcaggcaaggttgaacttagggaaaaggaaccggaaaaaaaaaa

SEQ ID NO: 34548 - DNA, 230 bp, Homo sapiens
  misc_feature 51: s=g or c
ctttttgcctggtaaccaggaggagtggctgaggcagggcatggagcggasaacgcagctacaaagtgcggagaggagccccgctctggatcccgccggctccccaaggctgaaggagacaagtctggatcgcaggagcccccagtaagaacagcagccgcctggggggccgaccatgtatgtgtacagctggccgccgcccaaacagggcgtctggccgccgccgccac

SEQ ID NO: 34549 - DNA, 302 bp, Homo sapiens
  misc_feature 123: r=a or g
  misc_feature 124: w=a or t
agaacaaaaggagaggagagacaataggagcttcgtgtgggctgtccacctgctacacagatttcttccctcccctcccctccacttgctttgcctggagttacactgatggtcgacgggtgrwgggattttctaccctagcaaggatggtacgaagattccaatgttcattgtgcataaaaaaggcataaaattggatggctctcatccagctttcttatatggctatggcggcttcaacatatccatcacacccaactacagtgtttccaggcttatttttgtgagacacatgggtggta

SEQ ID NO: 34550 - DNA, 235 bp, Homo sapiens
  misc_feature 55: s=g or c
  misc_feature 107: r=a or g
  misc_feature 205: h=a or c or t
tcgaaatacaatcccggcccctgacataccagaggcggcggcgacggcgacgtcscaccccggctcccttctcggtccccgggtaccctggagcgctccagtttggrcaaactgggaaaggaagctgctggccagagctatcgtgcacgggcaaaacaagccccgccggggctcgggattgcccaggaccttctggagcccctahctcggagccgagggaggagaaagcggcagt

SEQ ID NO: 34551 - DNA, 432 bp, Homo sapiens
  misc_feature 121: k=g or t
  misc_feature 122: r=a or g
  misc_feature 123: r=a or g
  misc_feature 335: s=g or c
  misc_feature 427: h=a or c or t
ctctcttccccttctgccttctgccatgagagaatgcagcaagaagggcctcaccagatgatggtgacttaatcttggactcccagcctccagaactttctaaggcacattacaaaaaatkrrgaggaagaaagttgtcagttctgttctgacaggcctctgctactgaacagtgggattcttcttcacatcaaatcacaggcgcagaagacttgcatatcctggggtaccaaatcttcagaatcttgacttaagaaagtcagaattggaaacagagctgctacaatggcaatgacgagctgctcagctcctgaaacaaattttctttgtcctasagcaacggatctgcaaattaattttctttctttgctggaatctgttaccttgcatccactcatgggcagtcacctagaggcttccccaccahcggca

SEQ ID NO: 34552 - DNA, 106 bp, Homo sapiens
ttctcacttacaaaagtaaaatttgaaatgatcagtggtcaccccatctgtatatttttgccaccactaccagaagagccatgtcattaaaaaaaaaaaaaaaaaa

SEQ ID NO: 34553 - DNA, 250 bp, Homo sapiens
taaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaattaaaaatgatatgctaactgagaaagatgcccgatacctggctgttaaagaagtgcttt

SEQ ID NO: 34554 - DNA, 346 bp, Homo sapiens
  misc_feature 256: k=g or t
cgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggtkagccatagaggttaaaactacctggttatcccatataataacacaaactgggtcttggatacacagttgtatttaatgttttacgatcta

SEQ ID NO: 34555 - DNA, 78 bp, Homo sapiens
gtcggtttccgcggtggccatgactgcggccgtgttcttcggctgcgccttcattgccttcgggcctgcgctcgccct

SEQ ID NO: 34556 - DNA, 163 bp, Homo sapiens
  misc_feature 126: w=a or t
  misc_feature 128: w=a or t
tatgtttagaaacttctatcaatcattatagctttaaaaatttcctgataccgtaagcctcatgtgtaaaaatttctttctggtaagttaccattaaaatatatctggtgtgcaaattttgataawtwattgaaaataaaatgtgaaatcttattgggcataa

SEQ ID NO: 34557 - DNA, 170 bp, Homo sapiens
  misc_feature 125: m=a or c
  misc_feature 127: m=a or c
  misc_feature 135: k=g or t
ttttggattggaatgtgcagtaaaaaaattctacggtgctcacacctgcaatcccagcaccttgggaagacaaggtgggtggatcgcttgagcccaggagtttgagaccagcctgggtaacatamcmaaaatcckgtctctacaaaaaacaaacaaacaaaacccaaact

SEQ ID NO: 34558 - DNA, 175 bp, Homo sapiens
  misc_feature 10: n=a, g, c or t
  misc_feature 99: w=a or t
gcgttttctnggtttcacttccggtaggagagtcccaaacggccagcggctgggaatttgcggtatcgcgggggggtgggaaatttccctttgttgcgwtgctccttctgatgtcagccttcaaaacgtttgtgggactcccctttgatttgagtctctgctgctagcagctgcg

SEQ ID NO: 34559 - DNA, 137 bp, Homo sapiens
  misc_feature 133: m=a or c
cacaaaacaatggatctatcatagaaattggctttactgtattgtgagaacctactaaagttttcatatatgcctattgtttttgcacctgagctacagcctggagctggtaaggcaagcagttgaaaaaggmcaaa

SEQ ID NO: 34560 - DNA, 200 bp, Homo sapiens
tagatgctctttatcaagttgaagccatttcattctattctttttttaatgtgtgtgtgtatttatatgtatgatagatttttaaaaaatttcagccttgatttttgatacaggaagtacatgtgaaggattgttacatgcatatattacacccagatagtgaacataataccaaataggtagtttttcaactcacaccg

SEQ ID NO: 34561 - DNA, 316 bp, Homo sapiens
aatgaaatccacaagcagacagcccagcgccacaccctgggcctggtagttaaagatcaacccctgacctaatcggttatgttatctacagattacagacattgtatagaaatgcactgtgaaaatccctatcctgtttttgttctaatctaactaccggtgcatgcagcccccagtcatgtaccccctgcttgctcaatcaatcatgaccctctcacacacatccccttagagttgtgaacctttaaaagggacaggaattgctcacttggggagctcagctcttgagacaggagtcttgccaatgcccctgacc

SEQ ID NO: 34562 - DNA, 380 bp, Homo sapiens
  misc_feature 137: s=g or c
  misc_feature 138: s=g or c
  misc_feature 216: d=a or g or t
  misc_feature 217: w=a or t
agagcggctcctggctcctcagaccgccgcagcccgtggctcctgccctgggtctacccagggctacaagggtcttttgcggtcgaccctgcggggaaccggtgggaaaactgaggtccctaaacacagattcggassgccctcttccagttggcagctggatgccagccagagctatgctgtgcccttgccctgagagtttcccgggcaccgccdwatcctgagcgacatcagggggcccgggtcacggtcgacttccaggggtctccacagccacgaaggttggggcccgccttcctggagcgagtaatccatccatcccgtgaatacttgccaggcacattgctaggtgctggagaggcaatgagagcacattcgga

SEQ ID NO: 34563 - DNA, 452 bp, Homo sapiens
  misc_feature 73: y=c or t
  misc_feature 130: r=a or g
  misc_feature 136: m=a or c
  misc_feature 291: m=a or c
  misc_feature 292: m=a or c
  misc_feature 383: b=c or g or t
  misc_feature 384: h=a or c or t
cagttatatattaaatatgaagcaaatccagtatcatgtacctcatgcaagtagttctggccgcaaagtgcgycagatcatgcctctcctttccacctgggcctccctgtctccctcccataagattagrtgggcmaagtaaatttcagcctgggccctgacagagtgatcatgaatttctagtaaggggtgggggtgtcctgaattaataaggtagcattttaatgcatcagtctgcgtattaccacgtctcattcatataaacaagacagtggtcatgaggagaagggmmacaaaccatgtaattggggcagaaaggactacatttttacagctgtgacttaagtggggagaagcatttgttgtgcatctaaccctctgcbhggagcttcacagagattacttacattgaatcctttcagttgccatgtcgtcctatgttagagaatagt

SEQ ID NO: 34564 - DNA, 108 bp, Homo sapiens
gttccaactttaacacgagtttctcaaacagtaaacatcacacaggccacgcagcccaaggacagacgggtctgggtgtgcaagcgcagaggactttagagatgaaca

SEQ ID NO: 34565 - DNA, 420 bp, Homo sapiens
  misc_feature 70: m=a or c
  misc_feature 71: w=a or t
  misc_feature 72: n=a, g, c or t
  misc_feature 73: r=a or g
  misc_feature 127: k=g or t
  misc_feature 270: r=a or g
ttgcaaaatcacaatttgctccagggattcttcattgcatccgaggcctgagaaccaaggacctagaatmwnrgtccagatgttcccgaaatctgtgtcttctacaagttagttactcacattctgktttcaagatctttttgagtcccgatagcatttatactagtacttaatatatttatttaaattgattcactcttttctttgtttaataagaagacgttggtactacacagacataaaaagaagatacatatacattaaaatgaratatatctgttaaagtgtaacatttgtcatacatcccgtatttatttcaagcattttttctctgctagcttacatttatttccagctctttttgatagcatttagatgtttttgtgattgatgatacagtttacacaattggatgagatt

SEQ ID NO: 34566 - DNA, 66 bp, Homo sapiens
  misc_feature 63: y=c or t
actgtgaacgctagaactcgggagcctgctcgctgttgttttttcgggtttcgtttttttttyctt

SEQ ID NO: 34567 - DNA, 63 bp, Homo sapiens
  misc_feature 37: s=g or c
  misc_feature 40: s=g or c
  misc_feature 41: s=g or c
tcgcgtcccggaagcggcggtggcggccgcggcgtasgcssaggagattttcggacctgcgac

SEQ ID NO: 34568 - DNA, 381 bp, Homo sapiens
  misc_feature 85: s=g or c
  misc_feature 103: m=a or c
  misc_feature 262: y=c or t
ctccgggtaagatggcagcggacggacagtgctcgctccccgcttcatggcggccggtgaccctcacccacgtcgaatatcctgsaggtgaatctctccggcmacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccayggccctgtggaggcccccacacagcagtgggcaccaagtacgggatgccctccagccattcccagtttatgtggttcttctccgtctattccttccttttcctgtatttaagaatgcac

SEQ ID NO: 34569 - DNA, 204 bp, Homo sapiens
tgtgtagatcatctctttctagtgtaaactaaaaataaaattctaagccctcttgactatctgaatggacccctcctctaggccaacgtcattcccaaaattaacctgaaaaatgagttcagaccatgatgagaaggagaggtaagacatgcttcattataccctcctcttttttggaattcaggaaaagcttaccagcgccaa

SEQ ID NO: 34570 - DNA, 383 bp, Homo sapiens
cactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcgcaggccacttcctctgccccttcccagccctgcaccaaagctgcatttcaggagactctctccagaca

SEQ ID NO: 34571 - DNA, 227 bp, Homo sapiens
  misc_feature 152: n=a, g, c or t
  misc_feature 211: s=g or c
gatgactacttgccccaggagaaggggccgtagggccagggggccctgaggtgctgggcaggagcctcacagacccccgtctgcccacagtgaggccgtctgggagaacatggcgcgcatgtgcgtgaagacccagcggctggacgtggccnaggtgtgcctggggaacatgggccatgcccgcggggcccgagcgctgcgtgaggcggasaggagccggagctatg

SEQ ID NO: 34572 - DNA, 77 bp, Homo sapiens
gatacaaataaggaaactttcttggtgatattgaatactttaaaaccttctgagactcaatcacatgtcctcatctt

SEQ ID NO: 34573 - DNA, 164 bp, Homo sapiens
  misc_feature 127: y=c or t
  misc_feature 128: h=a or c or t
ctcttcaggttagcgattacagctggcagcagacgaagactgcggtctttctgtctctgcccctcaaaggcgtgtgcgtcagagacacggacgtgttctgcacggaaaactatctgaaggtcaactyhcctccatttttatttgaggcatttctttatgctccc

SEQ ID NO: 34574 - DNA, 60 bp, Homo sapiens
  misc_feature 10: k=g or t
  misc_feature 18: k=g or t
  misc_feature 32: k=g or t
cctgagggckttgtcatkcccagaggaaatgktctcttcacggtggaaaacacagatcca

SEQ ID NO: 34575 - DNA, 330 bp, Homo sapiens
  misc_feature 121: r=a or g
  misc_feature 280: k=g or t
  misc_feature 289: k=g or t
  misc_feature 295: k=g or t
atatacctgcctcggcctcccaaaggcatgaaccactgcatccagcttcagatttcagctgtgttttgtaattctccttgtggagatcgttcacatcttaggttagttgtatttgcagggrttttattttcatcctaggtgttgtaaatatgattgtgttcttaatttaactctcaacctggatgttgttgttgtatagaaatgctactaattgttgtacattgattttgtatcctgaaaccttgctaaaatcctttatcatttctagtagacttttgtkgaagtcttkaaggtkttttaggtatagaaggatattgttgggtgaagaca

SEQ ID NO: 34576 - DNA, 95 bp, Homo sapiens
  misc_feature 3: k=g or t
  misc_feature 25: k=g or t
  misc_feature 32: r=a or g
ctkaaaatagagaatattagaggtkccttggraggaaaataagcaacactgaagtcaaatctttatcatgtttgctagaaatgttactaaaaaac

SEQ ID NO: 34577 - DNA, 55 bp, Homo sapiens
  misc_feature 22: r=a or g
tgataagtaacacatcttggtraggaaggcttgcattggcagagcatctgtagaa

SEQ ID NO: 34578 - DNA, 324 bp, Homo sapiens
cctcaagcttgcagagcaggactgcagcaaaagtgacgaccctcccatttctgattgccctgcacctggtattggcatctgggccaccagggggctagggtgggcatctctgcccaagcccaggccctggcatggcaagggcaaggcttcatctgtggtgtgccccaacctctccctttccctaagttccccccaaggttccaagattcctgcttccactccccagagctggagtgggggaacaagcctcgccttcggtacttgtgtccccagatggggcaagggacttcggaggaaccggtttaatgccctcccccccacccc

SEQ ID NO: 34579 - DNA, 342 bp, Homo sapiens
  misc_feature 54: n=a, g, c or t
caattaaatgctacatttggcaaaatgagaaagaaagaatttcctttactaggnttgtaggaagcctgcttttacaaaaacccaaatgagatcataaaactaaagtactgggacaaacagtgggaaacagtgcaatgggttcttttcaaccaagtattaaagtattggagatattgccgggcgcggtggctcacgtctgtaatcctagcgctttgggaggccaaggcgggcgggtcatgaggtcaggagttcaaggccagcctgaccaacatggcagagctccgtctctactaaaaatacaaaaattagccaggcacggtgggacgcacctttaatcccagc

SEQ ID NO: 34580 - DNA, 119 bp, Homo sapiens
gtgtaatggaagacctttgagaacctgggtgtattaactttgtgtatatagtgtaaatatccccactgtactgttagaggccaacaaattctagtatggcttgttggcaaagagtgcaa

SEQ ID NO: 34581 - DNA, 393 bp, Homo sapiens
  misc_feature 344: s=g or c
  misc_feature 345: r=a or g
  misc_feature 376: n=a, g, c or t
taaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagasraatgtctaatttacatctggtgactcaagtncaagctgactactaaga

SEQ ID NO: 34582 - DNA, 144 bp, Homo sapiens
tcagttcttttgtatttgctgaggagagttttacttccaattatgcgatagttttagagtaagtgccataaggtgccaagacaaaattttgtattttgttgttttgggaaggagagttctgtagacatctatcaggtccacagt

SEQ ID NO: 34583 - DNA, 324 bp, Homo sapiens
acagtcgcagccccggcgccccgaagcgggaaaaaggctgggtgccgccgtcccccagctgcgcaaccctaggaactctcggcaaaaaaaagagcatgaggaatttgaagactgagagatgagttgtgtagcaccaacattttctttctgcctgaccttcatacctgatgaattaaaagggcaataattaaggtggaatttgcctcacatgaagttttattattttagttattaaaatagtttccaacactactgagaagcaaaaagcaattctcgttgttttaagaacataggatgtttggaagagtgagataagggactgat

SEQ ID NO: 34584 - DNA, 138 bp, Homo sapiens
tctatgtacatataatatgtatgagaagactgttctcatagttagttgactcatatggtagagaggactttacatgaaatcagtatgaaaatagttttttagatacccagaagcttgttctgggagaagctagggcgg

SEQ ID NO: 34585 - DNA, 188 bp, Homo sapiens
  misc_feature 96: k=g or t
  misc_feature 110: m=a or c
  misc_feature 119: m=a or c
  misc_feature 123: m=a or c
  misc_feature 162: y=c or t
gtgtcctggagcttgacgcgctggagcttgagaggtctttcaggactgattttggtggaagaagacagcaggcggtgggcattcactgtgctggtkgggaagtctggttmcattaagamaggmattctagcaaagttattctgtaaatacaacagaatcagytgcttttgttaaatatattggtgcag

SEQ ID NO: 34586 - DNA, 118 bp, Homo sapiens
tccactgaaatcttttccagctctaagattttaaattgtccttttagattagacttgctgagtttaattcagattacctaattttaaaatgtttctgaaaaagtgaacagagttacct

SEQ ID NO: 34587 - DNA, 307 bp, Homo sapiens
  misc_feature 91: m=a or c
  misc_feature 139: s=g or c
  misc_feature 286: r=a or g
aacctgatggggtcccttttcaagctgtggaacctttgttctttctctgtttgcaataaatcttgccactgctcactctttgggtccacamtgcttttatgagctgtaacactcaccgcgaaggtccgcagcttcactsctgaagccagcgagaccacgagcctactgggaggaacgaacaactcccgacgcgccgccttaagagctgtaacactcaccgcgaaggtctgcagcttcactcctgagccagcgagaccacgaacccaccagaaggaaaaaactccgracacatctgaacatcagaagc

SEQ ID NO: 34588 - DNA, 290 bp, Homo sapiens
agaaaaaatatttatgtataaatccacacatttgccatttcttgtgtgcttcatttcttcctgagatctaaattttttccatttggtattatttcccttcagcctgaagaactttctctattgtttattatagggtaggtctgctggtgattaactttcttagctttcatttagccgaaaacttcttgaatttgccttcattttgttgctgagtatgtagtattctaggttgacagcttccttttttttcttgcagcattgtaaatatgttgttccattatggcctccca

SEQ ID NO: 34589 - DNA, 379 bp, Homo sapiens
gggctgtcgtgctgcaccactggaccatccccagcttcttcgttttcatttgctggtcttccactaagtcttggctcttattcttgaatttgtgtgtgccatttacctacttggtgctgatctaaaatattttctactggcttcaaccagttgtcacagcatgtctgcaatggaagtgtttttcttacataaaaattattcagcacacttattctgagggacactatacctctggaaaaacaacagtttctaaatgagggcattcttagtcactatgactgttgctactttctgtagtattatcacaaattttaatagaattgcatgttacttgcaaaattatttcagtatgaaaaatgatcttacaattaagtgttaa

SEQ ID NO: 34590 - DNA, 363 bp, Homo sapiens
  misc_feature 71: w=a or t
  misc_feature 72: n=a, g, c or t
  misc_feature 129: r=a or g
  misc_feature 132: r=a or g
  misc_feature 133: h=a or c or t
  misc_feature 143: r=a or g
  misc_feature 144: r=a or g
  misc_feature 201: r=a or g
tatatccaaattgacgaattggttgccaacagaacctcatggttctctgactaaatgttaatgctagtcawngccctaagaacaatttcagatgttcatttaaatttattaaattgtagcaaataatartgrhagtcaccatrrtttaacatccaccatgagtatatcttgaaaagacagactaattcatcagctacaacrgcaggcataaactgggattgtcctgggcaacaaacttgccttgtggtcaccctacttaatggccatttgttactagattttgtcatttagactcatacaacagtttcctaaacgttgtccagctttttatcacagagatagcttagatctatgtctctagga

SEQ ID NO: 34591 - DNA, 440 bp, Homo sapiens
  misc_feature 144: n=a, g, c or t
ctctagccctccttccctgggaggggtgggattgggagtgttctgttttcattactgcaccccttcccctaaagacaacgggactgccctcctccacagcgccttacctcaaacaggggaccgatcttgttcttctccaggttngacacctaatttgcacatcaggactgccatggaccatggtgcaatgaaggtgaagactggagcactcatcacccacgggtctcactttgttgcccaggctggagtatagtgccctgatcacagcttgctgcaacctcaagctcccatgctcaagcaagcttcctgcctcaacttcccaagtagctgagaccacaggcatgctccatgacacctgaactcctgaactcaagcgatcctcctgcctcagccttccaaagtgctgggattacaggcatgagccctgaacctgcctaccc

SEQ ID NO: 34592 - DNA, 345 bp, Homo sapiens
  misc_feature 121: d=a or g or t
  misc_feature 136: k=g or t
  misc_feature 265: w=a or t
  misc_feature 293: d=a or g or t
  misc_feature 294: h=a or c or t
  misc_feature 295: w=a or t
  misc_feature 311: s=g or c
gacgttaacaccctcccagggagaagcgctgttccttctggctgggaagtgcgagccggtggggggagagagcggagtagagcattacgtggaggtacttcccggttcccttgcgtctgadggccttatgccagakaggatagaaagcccaacagaaactcaagatagaagatggagaatctgcgagtgtctgtctcctgtcaagcttccctaatacggccctggtagaacttcatcaacagtggaaggcatttgcaaaggtgawcccaaaccagcacccctttccacacagdhwgtccatgtaagaaggsccagatgcttctcagggtctctgagaggatacaa

SEQ ID NO: 34593 - DNA, 163 bp, Homo sapiens
  misc_feature 106: y=c or t
  misc_feature 151: y=c or t
ttttttcctcccagactggttgtgcaggaggaggcatgagtgtggccgttgtgggtgcatgcgcgtcaggcctgggacccggccgcccgcccgctgcctcacctgyaaggaggggcctcccagaaactcccttccccagtgcccagccgcyccaccccgccac

SEQ ID NO: 34594 - DNA, 181 bp, Homo sapiens
agcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggcc

SEQ ID NO: 34595 - DNA, 359 bp, Homo sapiens
  misc_feature 72: v=a or c or g
  misc_feature 127: s=g or c
  misc_feature 320: h=a or c or t
  misc_feature 355: r=a or g
atgatccagaacagacggtgaagagacaaaacagcgtgaaagggagcggcgatacctaaactgacctccggvgggcagcatgatcaagggaaggagctgttctcgctccgctcaaacccccgcgcasctctgcagcttactcctgcttcggaaggcggcgaggttccacccccaccaccccggtccccgccgccctcttcgcgctgaagctgcggagggtctttttcttcagcccccaaatcctctgctctgtggcttaagattcccaggcttaaacccataactgctagggtcatcactcctcaaacttctccctcachtgttttgctgatgacggacacaggggcctcacagrctca

SEQ ID NO: 34596 - DNA, 105 bp, Homo sapiens
  misc_feature 88: s=g or c
tgtgccatggtggtttgctgcccctaccaacccatcacctgggtattaagccccgtatgcattagctatttatactgggctctacctscaaccctcaccccccaa

SEQ ID NO: 34597 - DNA, 232 bp, Homo sapiens
atctgaatatgccttcttttttaattagaaatatcttcgagacttgggtgtttgttaataactaataactggagtaagctacaggatctaaagcaccccctttttacagtctagttaggagagagaaaataattgcaaatatccacttagaggcaaagaacaattttttattatcaaaaaggtttctgcacattgttgtggcaatattgtatctgtttagaaaatgggcttt

SEQ ID NO: 34598 - DNA, 372 bp, Homo sapiens
  misc_feature 89: d=a or g or t
  misc_feature 96: r=a or g
  misc_feature 331: b=c or g or t
agatgttaatgaagaatatggggctaggaatcgtaagagttccaaagaaaaagtggctgttctggaagttaggaccatttctgaaaaadgccagtrataagacagtccaaaatttaagtaaagtacagcatcaaaaacttggtgatgtgaaggtggaacagcagaaaggattgacaatccagaagaaaactcaagtgaatttccagtcacctttaaggaagaaagtaaatttgaattgtccttggcaacaagtgtgacttacaggagcagcggcgtgtagacccagatgtggctcagcactgggccaagtcagagaaggtgaagctgtggbaggtgtcagtggcggaccggcgctccctcctggagcccttt

SEQ ID NO: 34599 - DNA, 256 bp, Homo sapiens
  misc_feature 98: m=a or c
ctgcccctgcctgcccatctggcctatacgccagccgtggggcccggggtccctgccgcagccccctccccttctgatgccttaaaagctgggccccmaggcctgctggccagagccacagatgccaagctctgggagcttgactatggaccaaacagctctggcctagggattgggccaccctacccaggatctccaccctggggacagtagaaggggaaagccttcatcttggcgaacggccccaccaccccgc

SEQ ID NO: 34600 - DNA, 253 bp, Homo sapiens
  misc_feature 133: k=g or t
aaaatgctcgtatctcagtgatgggaggagagcaggcagccaatgtgttggccacgataacaaaggaccaaagagcccgggaaggaaagcagttctccagtgctgatgaagcggctttaaaagagcccatcakttaagaagtttgaagaggaaggaaacccttactattccagcgcaagggtatgggatgatgggatcattgatccagcagacaccagactggtcttgggtctcagttttagtgcagccctca

SEQ ID NO: 34601 - DNA, 320 bp, Homo sapiens
atcttctacttttatcctgcagataagctgttcctcagtttccccctcccttcatttgctccatttgtccatcaccccatcttcccctgatctcttcctttaggaagatgtctagagtcaattccttactgcgtttagaaggctcacttagagcagatcagcagtggcaaatcagtaggtgattcaaaagactctcaagctataatttacatcttaggaaaagcctgaataggtagctctcatttttcacaaaattttttcttacctgtcgataataatattaacaatgaatctgcctgttcaagatggctgacagagca

SEQ ID NO: 34602 - DNA, 105 bp, Homo sapiens
cttttatgagctgtaacactcacggggtaggtttgcagcttcactcctgaagccagtaagacaacgaacccactgggagaaacaaacaactccagacgcacctcc

SEQ ID NO: 34603 - DNA, 359 bp, Homo sapiens
  misc_feature 127: s=g or c
  misc_feature 359: r=a or g
gaaaggggggtgacgtcccgcggacttgaggcgggcagatctggggggccccgactccccagcggccctgtagtggtgcgggcgaaactctggccccagataggaccgggaactagatcaaacctasctggattcttgtgaaccattcatgtgaattatttggaactggaatttcacacagacccggggaatttctcaaagttcaagacgggtcatattccgtggaatacggaaggagttggagtgatttcacttttctgatcaagaactgatagccattaaaactcagctccgcaatatatccccccactccaagggagggctgaaatgatcacttcgttttctgttacggctaccar

SEQ ID NO: 34604 - DNA, 135 bp, Homo sapiens
atatatcaacttgacaaaggagtgtggtatcggacgtgggagagagtcctctgtttgccacctgggcgctcattcaggcgtgactttggagatttctatagttttagaccaaactatttttttttccccagctat

SEQ ID NO: 34605 - DNA, 364 bp, Homo sapiens
  misc_feature 66: n=a, g, c or t
  misc_feature 138: v=a or c or g
  misc_feature 340: r=a or g
  misc_feature 364: k=g or t
ccatttgttttgcagagaaatgtttttcatttcccgtgtgtttccatttccttctgaaattctgantttatccatttttttaaggctctctttatctcctttcttaaggcactgttgctatggcacttttctataacvttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggraacagagctagtcagatgtgagtk

SEQ ID NO: 34606 - DNA, 198 bp, Homo sapiens
  misc_feature 87: r=a or g
  misc_feature 166: n=a, g, c or t
taaaatataatagggggcagaagtagaaaacataccaaaaagaacaacaaatgatgagtagatgtttaggttacaagtttatatatratgtctgtgtctgtgttaagattagggaattgtgaggtgagtctcggaactcaattctttctgttattttggctagacnctttggaagtagtgtgctatagaaaggcctat

SEQ ID NO: 34607 - DNA, 302 bp, Homo sapiens
  misc_feature 88: w=a or t
  misc_feature 94: r=a or g
  misc_feature 95: w=a or t
  misc_feature 98: h=a or c or t
caatagatttcaggcaagagggccagatacctaacaggtttttctccgtgaatcttatgctgagtagtttttcctcataaccaagcawttatgrwtahattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagcgcccc

SEQ ID NO: 34608 - DNA, 124 bp, Homo sapiens
  misc_feature 95: m=a or c
aacctggacaatttaagttattcttacataattgtgaataaagaaaatcattttgttctgagttcaagggtttagaaaaacagagcattgccaamcccaagaaaattcgaaacacaatgggaac

SEQ ID NO: 34609 - DNA, 61 bp, Homo sapiens
  misc_feature 26: s=g or c
  misc_feature 31: k=g or t
  misc_feature 32: k=g or t
tactgatcgttcaaaaatgtccccasatgtkkgcatctgggcgatttattggagtgctgct

SEQ ID NO: 34610 - DNA, 73 bp, Homo sapiens
acattacattaggtatttctcctaatgctatccctcccccagccctcaccccatgacaggccctggtgtgtga

SEQ ID NO: 34611 - DNA, 169 bp, Homo sapiens
tttcttgaacacctggacaacatgatctattcaactagcttgcaccctggtggagctgggggcagcatttctggaatcctcctaaccattgttcactgcttgtagcagagtaggtgggccccagggttagtgacaagtcctttcctgcccttcccaacacccagcccta

SEQ ID NO: 34612 - DNA, 448 bp, Homo sapiens
gcaagaaggggccccgtatctgaaatatttcaaccgctagtcacacctgtcggtgccaaggcaacatcccctgtttaatagcagcaggaagtcacatttttggcagtacctgccagactcacttctaagtgcttcgtgtatacgcatccactgggtccttcagccaccccaggaggttggcaccgttgttatccctgtttctagaggaggaaatgtgggcaggttcagagagaggataagtcactttctgaagtgatccatctggatatggtagaatgggcttttcacaaagctggcttggccccagcatctacactcttgactacctcgccagcctgccccagcagcaggtgttacgggagaccacgcccatctctgtctgggagttgagcagcaggtgatgcacagttcttaaaagtagccataatcaggatcataagcttcgtta

SEQ ID NO: 34613 - DNA, 102 bp, Homo sapiens
  misc_feature 48: s=g or c
  misc_feature 72: h=a or c or t
  misc_feature 73: n=a, g, c or t
acccccatgagctcagcttgccaaagagcctagactgggatctacgtsgcaggctttatacacgcggcggahnctaacaccacccgcccacacacaacatac

SEQ ID NO: 34614 - DNA, 250 bp, Homo sapiens
  misc_feature 122: k=g or t
agagacccataaaatacctaagacgaaagttactaggatagccaggggcttgtcttccgggtggcgccgaggccaggaaactgtcctctctaacctatttccccagaggagtctaaattggkccgttcaactaccagcaaaggctaaagagaggctggagcccccaggacagccagaacgctgacactgcaaagggcctctgtccttactggggaagcccagtcctgctcagctgtcttcttcagctatc

SEQ ID NO: 34615 - DNA, 168 bp, Homo sapiens
  misc_feature 129: m=a or c
atattctaatggagagaaacgcacgtgcacacacacccccctaaacccacacaaatgaaaccccctctgcggagaagccggctacaggaaattgacttaggcacaggaacttgctaatccccttttgtmacattcggattgctcctgctgccccacacacactaaccc

SEQ ID NO: 34616 - DNA, 364 bp, Homo sapiens
  misc_feature 129: r=a or g
  misc_feature 290: h=a or c or t
  misc_feature 291: n=a, g, c or t
  misc_feature 343: k=g or t
  misc_feature 345: h=a or c or t
  misc_feature 346: b=c or g or t
atttacttctttttttgagacacgcttgtcttgctctgtctcccaggctgaagtgcagtggtgtgatttttggtgcactgtagcctccgcctcctgggttcaagtgattctcctgcctcagcctcacgrgtagctgggactacaagcctgcgccaccacacctggctaattttggtatttttactagaggcgggtttcgctatgttggtcaggctggtcttgaactcctgacctcaagtgatccgcctgcctcgggctcccaaaatgcatttaatcaggcgacatagaghngtcttgttataatataattatcttgtccctgtagacatttctaaattctatkthbattagacctcagcctcaa

SEQ ID NO: 34617 - DNA, 318 bp, Homo sapiens
  misc_feature 42: r=a or g
  misc_feature 118: s=g or c
  misc_feature 120: s=g or c
tagagaaaaactatttaaaactgtcagatcctgaccagcaarcccccccccagccccccttccaagtgactccgtgccttgagtgtgtctgcgtgtttacacccgtccctctgctggscsgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccaca

SEQ ID NO: 34618 - DNA, 409 bp, Homo sapiens
  misc_feature 120: m=a or c
  misc_feature 122: w=a or t
  misc_feature 128: r=a or g
  misc_feature 350: d=a or g or t
tatatcccttcctaccttctgcttctaaaatgataatgacttcctccaagactgacttctatatcttccataatttggtgagacagcttatctttccaatgatttcccatgatagttgamawgggagragtctttgttggcctagctgatgttcctgtggtacaggaagcatgctaaccgaggccaagtttatcatcttactgaagtggcaagtccataaagcccccaagtttttattttccaggttatatattgagccaagaatcttaggtgactgttattagaagcatttatagaccctgttttgttgaattgcttcagagactactcccatccgtagtggacttatdagtaattttgttgctgtcaaaacttacagaaaaacttctacaacagctttagctttttt

SEQ ID NO: 34619 - DNA, 180 bp, Homo sapiens
  misc_feature 128: k=g or t
taaaacaatatgagagggtctgtctctcttctctcacaaacattaataagacattgtgtttcaaatgctaagcatacatctaatacatggtaataaccccaagaatctttagctgttaccattatatktttatatttttttaattaaaattgaatccctttttttttttttttttttttt

SEQ ID NO: 34620 - DNA, 452 bp, Homo sapiens
agtccaaggtaactcccgctcgtagtggctcaaccctctttgtcaattcaccttcctctaagttaactatggctgctccacctgtctttagggaaacctactccccatcgcgctgggtgttttggagtttttaaaagcgtcgcggggtaaagtcagtgttgtgcttttccttttctcagcaggggtgaccctggagatcattaccaaaatttaaaaatttcaccactgggcacacatgttacccttctcgtgatggcatggcaaagcttgatttgcaagagtttcttttggattgtccccagtgattccctttaaaaataggagctccttcaagctcctgtatcagcagtgcttgcacctcataggtgatgatcatgagggggacaaggagcctctagacttaagagacaagttgccagcattctccagatggagtgtttccctctgcagca

SEQ ID NO: 34621 - DNA, 259 bp, Homo sapiens
tttgtggtgaccaagagccattcagcacttcatgttaaatttatgaatgctctcaacataatgttcctaatagggaggctgacagcttgcatttgtcattcttgctgactgtctcagggagtacagtggaatggccaaccacatgtggaaactaaatcatttcctcccacataaaggttatccttgcaaaatgtgaactccaaggtaccgaagagcatctttccctcgcaccatctgctgtctgatctctgcccctcta

SEQ ID NO: 34622 - DNA, 59 bp, Homo sapiens
ctaagcaaatcccctgaaattttcaattgttttaacatgtgatactttttttttttttt

SEQ ID NO: 34623 - DNA, 57 bp, Homo sapiens
  misc_feature 13: m=a or c
  misc_feature 17: w=a or t
  misc_feature 22: s=g or c
  misc_feature 23: k=g or t
ttccctatagagmagawcggasktacggcctgtggtcatggcgctgttcccagcctt

SEQ ID NO: 34624 - DNA, 221 bp, Homo sapiens
  misc_feature 28: r=a or g
  misc_feature 29: w=a or t
  misc_feature 127: r=a or g
  misc_feature 130: r=a or g
  misc_feature 133: r=a or g
  misc_feature 146: m=a or c
  misc_feature 156: s=g or c
aaaaagcaagacagcgcgcgttcccgtrwcctgcccctctgaatgtcggcggctccaaaagggtgacgtggagatgttgccgctcccgcccagggctgctttgcagtcggggagagatcctggctgragragrttttaaggacggmggaccgcatsggcgcgaattgagctctgggcccaaatatgaagtggcatccggtgtgaggctcgactgggcggct

SEQ ID NO: 34625 - DNA, 284 bp, Homo sapiens
  misc_feature 130: s=g or c
gctccgcctacggctgcaagaaccgctacgacaaggacaagcccgtttctttccacaagtttcctcttactcgacccagtctttgtaaagaatgggaggcagctgtcagaagaaaaaactttaaacccascaagtatagcagtatttgttcagagcactttactccagactgctttaagagagagtgcaacaacaagttactgaaagagaatgctgtgcccacaatatttctttgtactgagccacatgacaagaaagaagatcttctggagccacaggaacca

SEQ ID NO: 34626 - DNA, 163 bp, Homo sapiens
aattagcctggcatggtagcatgcgcctatagtcccagctgctcaggaggctgaggcatgagaatcgcttgaacctaggaggtggagattgcattcaactgagatcataccacttcattccagcctgggtgacagagcaagactctgtctcaaaaaaaaaaaa

SEQ ID NO: 34627 - DNA, 90 bp, Homo sapiens
  misc_feature 2: w=a or t
  misc_feature 10: y=c or t
  misc_feature 46: r=a or g
  misc_feature 51: s=g or c
  misc_feature 54: h=a or c or t
  misc_feature 74: v=a or c or g
  misc_feature 83: s=g or c
cwcaaaccaygacagtgtataatctcagcccaaggcccccagataraatastchtgctctgtcgcccaggctgvagtgcaatsgcacgat

SEQ ID NO: 34628 - DNA, 92 bp, Homo sapiens
  misc_feature 16: s=g or c
  misc_feature 51: s=g or c
  misc_feature 70: s=g or c
  misc_feature 71: n=a, g, c or t
  misc_feature 72: n=a, g, c or t
aaagtgagtgagtgasacgggcagatggaggagggattgtaatggcggcascggcagctccctgctctgsnncacggcaggcacacaacata

SEQ ID NO: 34629 - DNA, 474 bp, Homo sapiens
  misc_feature 138: k=g or t
  misc_feature 382: n=a, g, c or t
taagttttatgtagctatatggttcatatgtatatataattttatatatcaataagagtaaagacacgggtacaaattaagagttatatggttttacaagtatatgttaaccccttggcgctggcggtcacggtgcgkctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaangatcgaccacaaattgcaagagtagtgcagaaaaccagcagtggcttcagtgttcagtggatggcaggctcctacagtggctcctggactga

SEQ ID NO: 34630 - DNA, 236 bp, Homo sapiens
  misc_feature 133: s=g or c
  misc_feature 137: k=g or t
tggttttgataacctatactatgtaaccagagaagacaaagacctgcacagaaagatccaccggatcattcagcaggactgccagaaaccaaatcacatggagaagggctgtcacttcctggcacatcttggsctgkgctcgcctgagcatccgcccgggcctgagcgaggctgtgctgcagcaagttctggagctcctggaggaccagagtgacattgtcagcacaatggagctc

SEQ ID NO: 34631 - DNA, 195 bp, Homo sapiens
  misc_feature 144: r=a or g
tttttgttttatatctcctaatacttctatgtgcatattaatagatacctagttaatattaggttgaaactttgtttggaagtctgaaaagttctgatttttacaaaggcttatggtctgagaaggcagtaatacctgacagaraatacttaatattttatacaataaacatttaatgtgttaaacttgtgccaa

SEQ ID NO: 34632 - DNA, 84 bp, Homo sapiens
tgtttttcaaatatatcaagtatagaaaaaggtaaaacagttaagaaggaaggcaattatattattcttctgtagttagcaaac

SEQ ID NO: 34633 - DNA, 226 bp, Homo sapiens
  misc_feature 136: v=a or c or g
  misc_feature 159: m=a or c
tctttagcaagatattctggtttctagataaggaagagtctctaatgagcccccgagccccagtctcttcagctcatggattggtatgaggggtctgaacgtctcctagccaatcagaactggctgtggaccaccvtagcacggccacctctcagggcmactggcaggccttcctgagttagatttgtagttgcatatttagctttgcacatttgaaataaaccac

SEQ ID NO: 34634 - DNA, 371 bp, Homo sapiens
tgagtggttttgttttctgtgataacttggtttatataagtaatccacattacttgggtgttagtggtaagcagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctcgc

SEQ ID NO: 34635 - DNA, 125 bp, Homo sapiens
aaagagtttatactttgtgctaagaatgatggaaagctgttcaagtgttttgtttgtttgttgtgtgtgtgtgtgtgtgttttaacaggggaatgataggatctgatgtagggtgtggtttcggt

SEQ ID NO: 34636 - DNA, 117 bp, Homo sapiens
tcatttaccatgcagttcaccgttttaatgtgtccagttcagtggttgttagtgtattcacccagttgtgcagccaccatcacagtcaattttaaaacattttcatcaccccaaacc

SEQ ID NO: 34637 - DNA, 451 bp, Homo sapiens
taaggtaaaatgagctgcaacaaatggctaccaaaagatattatgtgaagtctattccataggctatttttcttcccttctttcccctccccacagctttttaaaaaaccatcatgctgattgaataattgtagagactggaaaatctcaaattgatatccttatataaaatcctgcctcagctcattagttcagaaagaaatccaaaagttcagttctctgagttgcttcaacacataagtatattagttttatgaaagattttttttttatttcataaaaccttaatacttctgccagaatcagaagtgcattgtgctctggtacaatttacatgaactttggttcccaccacctgttagctgcgcaggttttgccaattaagctctttgagactcagctcttaaattcaattataagaccagaatcttgctgttttttctatacatcc

SEQ ID NO: 34638 - DNA, 454 bp, Homo sapiens
  misc_feature 30: n=a, g, c or t
ccaggactccggaacctaaaaagataaaanaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgcagagccgaagaaggagactgaaagtgaagct

SEQ ID NO: 34639 - DNA, 339 bp, Homo sapiens
  misc_feature 169: w=a or t
  misc_feature 175: y=c or t
acgatcgtaccactacactccagcctgggcaacagagcaagaccctgtctcaaagcataaaatggaataacatatcaaatgaaacagggaaaatgaagctgacaatttatggaagccagggcttgtcacagtctctactgttattatgcattacctgggaatttatatwaagccyttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggtat

SEQ ID NO: 34640 - DNA, 212 bp, Homo sapiens
  misc_feature 189: n=a, g, c or t
acgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgccntccggcatctgcatctgggaccg

SEQ ID NO: 34641 - DNA, 492 bp, Homo sapiens
  misc_feature 181: n=a, g, c or t
  misc_feature 182: m=a or c
  misc_feature 329: n=a, g, c or t
  misc_feature 330: n=a, g, c or t
attactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaanmcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgnntttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatga

SEQ ID NO: 34642 - DNA, 313 bp, Homo sapiens
  misc_feature 311: m=a or c
caacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccgmtc

SEQ ID NO: 34643 - DNA, 244 bp, Homo sapiens
  misc_feature 79: r=a or g
  misc_feature 80: r=a or g
  misc_feature 127: w=a or t
  misc_feature 129: w=a or t
  misc_feature 136: y=c or t
cattcataagtattgttccttacaggtgcactggccggacctgaccccagggactctaccacagtacatgaacctattrrtaaaccattcatgcttcccagtttggcagatgtgagcaaactatgtwawaggaatyccaaaggtaactttttcctttcattactttacagaaatactgtcaagtccaatagagagcacagacttgggaggcggattgggtgggtttgaatctctgctctgccac

SEQ ID NO: 34644 - DNA, 187 bp, Homo sapiens
  misc_feature 150: k=g or t
  misc_feature 152: w=a or t
aaaaattctgggaaggctcgaggccgcggtccccggggtccgcatagtcccgatgaaaaacagacccgggaaagctggtgggagtcaggagccccggcgatgaggattgcgatgaaggaagcaggctcggagcgccgccagcgcatgcgkawttggggatctgaggccagcgtcttgcgccgccaat

SEQ ID NO: 34645 - DNA, 249 bp, Homo sapiens
  misc_feature 126: m=a or c
  misc_feature 130: w=a or t
  misc_feature 132: w=a or t
  misc_feature 139: w=a or t
atttgataacatcagctaatatttttcaaagttagatttttgaggtataatttacataagagttactctttctagaggtatagttgaatgcattttcacaaatgtgtacaattggataaccaccamcatwawtctagawatataggtaatgtgtaattataatatatatgtactatataatataggatatttataccacccaaaaagttttctcttgctttttatagtcattccccaaaccccacgtcc

SEQ ID NO: 34646 - DNA, 135 bp, Homo sapiens
  misc_feature 129: s=g or c
  misc_feature 131: r=a or g
  misc_feature 133: w=a or t
taggtctgatattcaaatggacaaactgccagttttgtttcctttcactggccacagttgtttgatgcattaaaagaaaataaaaaaaagaaaaaagagaaaagaaaaaaaaagaaaaaagttgtaggsgrawtg

SEQ ID NO: 34647 - DNA, 225 bp, Homo sapiens
aagagaaattagaaagcttaagtgaataaaactaccttgaaatcatagttttttacgtaggagggaatttaaaagtcatctcagccacccctgccaaattttacagataaaaaaactgagacctgaaaattcaagtgacttatcagaatcaacagctaaattggtgatagtgttgatctgaaaaccagatctcaggttcattgtttccgtaaatatatctgagga

SEQ ID NO: 34648 - DNA, 154 bp, Homo sapiens
  misc_feature 131: w=a or t
ggctcaaaggagatatgtataagaaagtggtttgtaaattatgttccatttcataaatagacactattcacaaactaaaatctaataaaaaaccacagttgtaatttaaactgcttgatataaaaagaggwatcatagcagggaaaacacacat

SEQ ID NO: 34649 - DNA, 379 bp, Homo sapiens
  misc_feature 119: w=a or t
  misc_feature 125: y=c or t
cacagtctttgaaacttagtttccacacttatttatttatattaacacttgagtcatgctaactctctaatcactggtattcaaacccaaaatttaaattgttgcttttcttagcctawttcacytccccaagtcctctgtctctatattcaaccacccttcaagacctatcttcaattgtataatttccagaaagactttggggatactgacactaaatttttttctcatttttgaatctctaccatgcttaataaaacattattaccacgctatttactttcatgtgcagatccttgagtaaaaaattatccctgaacttcatgtccagagacctgggttctacttatgactgtacttccatttagctgtgtagccc

SEQ ID NO: 34650 - DNA, 144 bp, Homo sapiens
  misc_feature 88: r=a or g
  misc_feature 126: k=g or t
ctatgggcgaatagctctgaccacccggcgaagagctgagaatgaagcggagagcatcagacagaggagctggggaaacgtcggccarggccaaggctctaggaagtgggatttctggaaataatkgcaaagagacctggagcc

SEQ ID NO: 34651 - DNA, 156 bp, Homo sapiens
  misc_feature 8: m=a or c
  misc_feature 14: n=a, g, c or t
cttcttgmtcctgnactgggttaggtgccgctgttgctgctcgtgttgaatctagaaccgtagccagacatgggactggaggacgagcaaaagatgcttaccgaatccggagatcctgaggaggaggaagaggaagaggaggaattagtggatccc

SEQ ID NO: 34652 - DNA, 403 bp, Homo sapiens
  misc_feature 170: n=a, g, c or t
  misc_feature 322: k=g or t
  misc_feature 343: n=a, g, c or t
  misc_feature 369: k=g or t
  misc_feature 374: n=a, g, c or t
  misc_feature 378: k=g or t
ctagacggcatcttccaatagaaggatgtttcatctgcattgaaaagtctgtttttcagtgtagccaccttcatcattatcttagatagatattatggataacttgctgaagcctccatatcagcacttgctgcttcaccttgcacttttatgttatggaaacagcatcnttccttgaatttcatgaaccaacctctgctagcttcagacttttcttctgcaacttcctcacctttctcaacctttataggattgaagagagttaggtattaggatctggattaggttttggtttaagggaatgttgtggctggtttgatcktttatccagaccactgaaacnttctctgtataaatgataagactgtkttgcnttcktaaacattgtgtgtcattggcgcgc

SEQ ID NO: 34653 - DNA, 71 bp, Homo sapiens
  misc_feature 18: h=a or c or t
ttagacaagaggtatgchagtagcacactggtggcttcagaagaaattctcaacacctagctcgccagaga

SEQ ID NO: 34654 - DNA, 87 bp, Homo sapiens
  misc_feature 74: n=a, g, c or t
cattaaggcctcagttcaaacatggcatcctaaagaaagctgtctctgatcaccttagctcacacacacccctnatgctactctttt

SEQ ID NO: 34655 - DNA, 81 bp, Homo sapiens
  misc_feature 12: r=a or g
  misc_feature 23: w=a or t
  misc_feature 35: w=a or t
  misc_feature 48: k=g or t
  misc_feature 53: k=g or t
  misc_feature 68: k=g or t
ctgatttcatcragttcgacacwggtaacctgtgwatggtgactggakgtgckaacctaggaagaatkggtgtgatcacca

SEQ ID NO: 34656 - DNA, 319 bp, Homo sapiens
aatctcgtggcggcttattgttattgccctgatacaaagttccatcttcctcatttgcctgggaccaatatgtctgagctccctcctcctggacaggaaagtaactacctagtcattctggggacccaaagaccttgctaccaagtgggtctcctaactaccactgagctggctagacaaaaaactttctgggtgatggtagccttgaggtttggctagggtcaccctcccatgacccagcataggattggctggaggctgaggcagatggatagactggggaaattcagggctgatgagaaggaagccactggccctc

SEQ ID NO: 34657 - DNA, 122 bp, Homo sapiens
  misc_feature 32: v=a or c or g
acattacattaggtatttctcctaatgctatvcctcccccagccctcaccccatgacaggccctggtgtgtgatgttccccgtcctgtgtccaagtgttctcattgttcagttcccacccta

SEQ ID NO: 34658 - DNA, 261 bp, Homo sapiens
caatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctctggctctccaattgtgtattctatcttcttgatgatttacacgtttcccttggttcccaggcctgattatactctgtccagcctctgcccact

SEQ ID NO: 34659 - DNA, 252 bp, Homo sapiens
  misc_feature 141: y=c or t
tatgttaattatcaaaactgcagtgtctcactgtgtaaccatttctgaggcacctgtaaataatatctgatgttacagagatgatcccagaaaaagccttcagtgaaggaaaaaacttaaaacttactatacacgtagccytcatcaaatttgtttccccaaatgtagatatgagagaaagtgagatttgttttcattgattgtgaaagtgcaacaagtccttctccctctatgttgttgctgactactgac

SEQ ID NO: 34660 - DNA, 407 bp, Homo sapiens
  misc_feature 300: m=a or c
  misc_feature 302: y=c or t
ctgcttcatatttttcttatgctctcacaccagtctttcttttgcccctctttctgattccaggggtatagttcacaaaaatttcactgtataatctgttctcaccatctgtttgtgtgcctaccattttgaaattatatcaggaattgaatgctgtaataaaactgtaaacatttacatgatttccttcacaatatatgctgagtatagttttgtcagatgcccaagttatactaggaaagagctaaattcattcaagttttttttctgattttttaattgtaaaatacacatctcatmtytaaatgtacagttcaatattattaaatacattcataacgttgtgcacccattaccaccatccatctccaaaagtcttttcatcttgtaaaactgaactcaaccca

SEQ ID NO: 34661 - DNA, 89 bp, Homo sapiens
tagattttactgcatagagccatagtggacaggagataagaggctggagacatcgaaacatcaactttcttctttctattccgcctccc

SEQ ID NO: 34662 - DNA, 171 bp, Homo sapiens
  misc_feature 132: r=a or g
tttgttattgcaatgaaaaggtggcatcaggcagggctgagatacttgggccattcttgtcccccaggctggcctctgctcccgtccaatcttcaggggagattagaatgtggcggctgaccctgtctgtgragccttagggaagctgtgatggctgaatcaggaccacat

SEQ ID NO: 34663 - DNA, 257 bp, Homo sapiens
cactcagccttaaatgttataatatttttggataacggttattaattctttgagaccttcgtatagcctataaaatgtatgggagatgttggtattttatgtgtataaaagcaacaatatcagcaactttcgggtttatactgcaccttggttgttgatgtcaagtaaaaaaaagattgttttgtaacacataaaaaaatggaagaaactgataccacacctaaggaccaaagataagaaagactttttgcccaacc

SEQ ID NO: 34664 - DNA, 476 bp, Homo sapiens
  misc_feature 148: w=a or t
  misc_feature 163: k=g or t
  misc_feature 458: m=a or c
  misc_feature 459: s=g or c
attgttaatgtgttgccacatatgtgtgtatataaattatttcctaagccacttgaatacaagttgtgcaaatgacaattcattctcacagatctcagcatgcacctcctaagaatacgaacattctctagtttaaccataataactwatgggcatcccctakgaaaaataataatttcataacatttaattgcccatattgaaatttctccagttgtaccaaaattatcttatcaactttttttttgtgcaaaccagaatccaaccaagagttatgtattacacttgatttttatatctttttggtatattttaatctggacaagtttctccatcattttatgcttttccaaactacttttaatggatttatatgaacgtatgtgagtgtgtgtgaatttatgtgaatgtatgtgtgtttgcacacacagagatgcaacaaaaacaggtctgaagamsagatttatgctgtgagt

SEQ ID NO: 34665 - DNA, 112 bp, Homo sapiens
gtgacccggacaccaggcatacgctaggggcagtcagctgtgccttctctttcggagttgttccgtgctcccacgtgcttccccttctccactggctgggatcccccgggca

SEQ ID NO: 34666 - DNA, 150 bp, Homo sapiens
  misc_feature 150: k=g or t
aggttaggggaagttgggggcaaagaatttaagtgagtcatagcatgtataccagcagcattgtaagtgacctgtatatgtgtgtgtacatggatgtggacattgctgggaggctgacataggtcccatagctaataaagggtaaggctk

SEQ ID NO: 34667 - DNA, 466 bp, Homo sapiens
  misc_feature 151: h=a or c or t
  misc_feature 299: y=c or t
  misc_feature 318: r=a or g
  misc_feature 324: m=a or c
  misc_feature 325: b=c or g or t
ccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggcccccahtcttcattggcttaacctaaaaaccagaggtgcttttccttgtctgtgtgccagttgctggctgttttatttgcttgcccttcattttgctactgattttccttaatttgtgggaaggagtaggcaaagaatatgcttacatgagtayacctgtaaagtaagcccaracatcmbaaatgtccatcaactgatgagtggattaataaaatgtttccatggaatattccttggattactcagccataaaaaggaatgaagtactgacacatgctgtgacatcagtgaaccctgaaaacatccttctcagtgaaacaa

SEQ ID NO: 34668 - DNA, 209 bp, Homo sapiens
  misc_feature 142: s=g or c
  misc_feature 145: r=a or g
  misc_feature 147: w=a or t
ttattattattattattttaaaaaagattgcatttagctgttgattcaaattaggaagtaagtttctctgttgactggtcactgatctttttgggcagtgcatgcttcagaaggagctctttcccatttgtttaggaggtgstgrawtaattttgaatagaactcataatatagcctgcaaaaattgttggtttttggtggaagagtca

SEQ ID NO: 34669 - DNA, 273 bp, Homo sapiens
  misc_feature 9: r=a or g
  misc_feature 10: s=g or c
  misc_feature 52: s=g or c
  misc_feature 136: s=g or c
  misc_feature 137: n=a, g, c or t
  misc_feature 138: s=g or c
  misc_feature 143: s=g or c
agagcggcrsaagatggcggcgcaacagcgggactgcgggggtgctgcgcastggcggggccggcggcggaggctgaccccctaggacgcttcacgtgtcccgtgtgcttagaggtgtacgagaagccggtacaasnsccctscggacacgtcttttgctctgcatgcctgcaggaatgtctgaagccgaagaagcctgtctgtggggtgtgtcgcagcgctctggcacctggcgtccgagccgtggagctcgagcggcagatcgagagcaca

SEQ ID NO: 34670 - DNA, 317 bp, Homo sapiens
  misc_feature 131: r=a or g
  misc_feature 195: h=a or c or t
  misc_feature 317: r=a or g
ctcgcgggtccgggagcgcggcggagacgatgcctgagatcagagtcacgcccttgggggccggccaggacgtgggccgaagctgcatcctggtctccattgcgggcaagaatgtcatgctggactgtggratgcacatgggcttcaatgacgaccgacgcttccctgacttctcctacatcacccagaacggchgcctaacagacttcctggactgtgtgatcattagccacttccacctggaccactgcggggcactcccctacttcagcgagatggtgggctacgacggccccatctacatgactcacccctar

SEQ ID NO: 34671 - DNA, 275 bp, Homo sapiens
  misc_feature 137: r=a or g
aatggtgagcaaccatgtggttaaatgtgaagattggagagctatctaagacttaaagggggtgtgcctgtccaggtactttgctacaaatacatgcgttttcaactatgctggttaaagcctgagcattagaaagraaaattggatctaaaggctgaaggccacaggccaggcccttgcaacctctttgggagctctgaaaagctttttaccctctctgggcctctgttttctccccagctaaaggaaagaaagaatgcctgctttttggtgac

SEQ ID NO: 34672 - DNA, 228 bp, Homo sapiens
  misc_feature 125: v=a or c or g
cacacatctgtttttttttaggtttggtaagtggagaaaatggctcctaagtgaggaggcagctgtgaagtcaaagggtcttagttttggatttagagagagctaggtttgcatcctcagtttgvtctaggtttgagcctcagtttccttatctgtaaaaggagggtttttttgtttttgtttttgtttttttttaaataagattaacgtaaggattaaaccagatac

SEQ ID NO: 34673 - DNA, 194 bp, Homo sapiens
  misc_feature 30: k=g or t
ctcagtattaagatcaaacctacttttatktatatccttttcattccttccctttatgccactatgctccagccaaacataattattaattccagaaatattccatgtaatatttgtggttttggctatgattttgcttgagccttgaatgttcctaaccgtaacctctgtatatccagaacttaagaccccgc

SEQ ID NO: 34674 - DNA, 452 bp, Homo sapiens
  misc_feature 145: w=a or t
  misc_feature 148: y=c or t
  misc_feature 150: s=g or c
  misc_feature 158: y=c or t
  misc_feature 398: s=g or c
  misc_feature 399: m=a or c
ttattaactatagtcattctactgcgctgtcaaacactagaacttattccacctaactgtatttttgcaccaagctttcttcattcctccctccccactagcctctgatatccaccattctactcactaccttcaagatattaawttycsttagcttycacatatgatatttgtcttgctttgcctgacttatttcacttaacagaatgtcctccagtttcatccatgtagttgcaagtgacatacatttattcttatcctgtaaagatgactgagaaaagcatgatttgcaattacaaagacttgtggtaggcagatttctaagatagcctcaaggtttcccaatcctagtgtacacaggctatataatttcttcccagtcctactgtactcagctsmtataatctctttcccttcagcatggttgagggctgtcaatgggaagggatatt

SEQ ID NO: 34675 - DNA, 250 bp, Homo sapiens
tagaaactgaggagtccagggagtacaccgaggatgggcaggtgaagaaggagacgaggtattcctacaacactgaatggaggtcagaaatcatcaacagcaaaaacttcgaccgagagattggccacaaaaaaccccagtgccatggcagtggagtcattcatggcaacagccccctttgtccaaattggcaggtttttcctctcgtcaggcctcatcgacaaagtcgacaacttcaagtccctgagcc

SEQ ID NO: 34676 - DNA, 79 bp, Homo sapiens
  misc_feature 34: k=g or t
  misc_feature 71: s=g or c
  misc_feature 77: m=a or c
aaactttttaataatccgaggagggaggaaagckctcggtcccctcggctccgggggcgcgcccccgtcasccccamcc

SEQ ID NO: 34677 - DNA, 218 bp, Homo sapiens
taagattcggactggggccatcaaataatcctgcttgagtgattctaccttgtttctaagtagtcattgcctgcagagttttgatgaaacatctaatagagaaattgtggagaggtatcatatgtaattgacagaatacaattggttgtactgaaatatcttccttatgctaaaagaatgaaaacattgatgcatcccagatttgtgggcctttcgtt

SEQ ID NO: 34678 - DNA, 197 bp, Homo sapiens
  misc_feature 143: w=a or t
  misc_feature 147: y=c or t
tatttaattattagtgaaaagcaccattttgagaggttttttgtgtttgtttgagactgagtctcgctcttctactgcccatgctggagtgcagtggcgtgatctccactcactgcagcctccacctcctaggtttaagcaawtctyagccttcctgagtggctgaaattacgggcgtgtgccaccatgcccagctc

SEQ ID NO: 34679 - DNA, 90 bp, Homo sapiens
  misc_feature 25: r=a or g
agttcactgctgcatgttgtttggratttatcaccttaagaaagtgtctctgttttatatagaaacactttctcacttacaggggagaaa

SEQ ID NO: 34680 - DNA, 218 bp, Homo sapiens
  misc_feature 146: y=c or t
caagcacaatttagactagggttgaaccactcattgttcaaatcattggtgggctccaatgtaaaatatcactacatcagtccacaagcaacattaaggaaatctaaaggaaatggaatttgactttttagagtataatgatggtyctagggcataatgaggaaaatttttaaaaaatagattataatgatacatattggtatcattaagacaacaga

SEQ ID NO: 34681 - DNA, 379 bp, Homo sapiens
  misc_feature 141: r=a or g
  misc_feature 144: k=g or t
  misc_feature 361: n=a, g, c or t
agcactaaacacagcaggcactgtcgatggtcccctgattgcaccttgttctagctcttagcttaggtactccctgggctttagcaagaatagtgttggaaatattgtcgaatagaatggtccaagcactagtcaatccarggkggatgctaagctgtaaaaagctgtgtgggctccctcatgtttattggatgaactgcaagcttgttcacgggccataaacagagctagcttcggttcttgtaggcaggaacaacattgtatttatatttgtaaccgcaatgctggggcttagtaggtagcggcaaatgtttgttagatgatttgctcttattaataattgaactttctcatgatgcgnccccagcatgtatcttga

SEQ ID NO: 34682 - DNA, 310 bp, Homo sapiens
gcattcttctaagctgtggcacctcttttcagaagcagaagcttcactgtatgcccttgagcatgtcactcaccagctatgcctgcagttaaagcagatagaagcttgtgacgcagactggtttggtagggaaaggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaa

SEQ ID NO: 34683 - DNA, 152 bp, Homo sapiens
  misc_feature 147: m=a or c
acagcaattctggacttacttggactcctgatgtcaattctgttgtcatatgcattgaagcttcgcaatgacaggagattaaacaaatgggaggagaattccaggaaatgaaaaagtcatacgaagaagagttatgttctacagccmaagcg

SEQ ID NO: 34684 - DNA, 214 bp, Homo sapiens
  misc_feature 100: y=c or t
  misc_feature 101: k=g or t
  misc_feature 142: r=a or g
aggagagagtcagtagaattagaacctccaacaggaagagaagaaactttggcttgcccatgggactagtaggagcccagtcagatctagtgtatcatgyktaacagaaaaacctattgtcacaggaaaagaaaaggctggraaaacatctaagcagggaatgctgtggccgatgaataggcatggtgggggtcccctcatgaggattcggtgc

SEQ ID NO: 34685 - DNA, 128 bp, Homo sapiens
  misc_feature 120: s=g or c
cgtttctaagtcaagtgcttagtgggtactggggccaggaggagtcctctggctgtgagactcctacatgttacctctttgttctaggcctcagctctgcttctagcccccaaattctastcatcctc

SEQ ID NO: 34686 - DNA, 200 bp, Homo sapiens
aaaaataatataaagataccattggggcagtggctcacgcctgtaatctcagcactttgggaggctgaggtggaaggatcacttgaagccagagtttgagaccagcctgtgcaacacggcaagaccccgtctctacaagaacttaaaaaattagctggctgtggtgttgctcacccgtagttccagctactcgggaagcc

SEQ ID NO: 34687 - DNA, 88 bp, Homo sapiens
  misc_feature 12: y=c or t
  misc_feature 13: k=g or t
  misc_feature 14: r=a or g
  misc_feature 24: s=g or c
cttcttgatccykractgggttasttgccgctgttgctgctcgtgttgaatctagaaccgtagccagacatgggactggaggacgagc

SEQ ID NO: 34688 - DNA, 453 bp, Homo sapiens
  misc_feature 355: d=a or g or t
  misc_feature 356: n=a, g, c or t
aaaatcaggaaaactagagcctcacaaattctgagacaaggactttatgctctctactctaagagatgggacattcacgatttacaacctgaaacacctctgacagaatagcaggcatcttgacgtaaggtcaaatagagagaacacccacatggactatgtcctaagtcaatcagataaaggatctgaaaacaatacatgttaaggaaaaggcacgtcccaggccagcctccagagtccaccttaacaagtggcatcaatggtcaagcctgaagagctaataagtataaattttaaatacatttgtccctcaattagttactaatgaatggttctcattagcagatgttccatdnatctgaagcacactacctttatgagtgaaagctttgggtaaacaacaggctgtgtgcattgatgacatttatgacttcccctcatctcctcctccca

SEQ ID NO: 34689 - DNA, 196 bp, Homo sapiens
ctcctgcctcagcctccagagtagctgagattacaggcgcctgccaccatgcccggctaattttattgtatttttagtagagacggggtttcaccatgttggccaggcttgtctcgaactcctgatcctcgtgatccacctgcctcagcctcccaaagtgctgggattacaggcgtgagccaccacgacccgccat

SEQ ID NO: 34690 - DNA, 63 bp, Homo sapiens
tattacagataatctcagtacatttttaaaaactgaaatcatatcatatcaatcatcttctca

SEQ ID NO: 34691 - DNA, 120 bp, Homo sapiens
tatgcaaatggattattgatcttttcataaaggaaaataaaaatttcaggacccccaaatttgttatgctaaagggagagttaagcttggagactgagccacacaacactggcattcctt

SEQ ID NO: 34692 - DNA, 128 bp, Homo sapiens
gcgggcctctcccggagaagatggcggatcgcgcggagatgttttctctctccaccttccactcgctgtcgccgccgggctgcaggcctccccaggacataagcctggaagaatttgacgacgaagat

SEQ ID NO: 34693 - DNA, 242 bp, Homo sapiens
  misc_feature 136: k=g or t
tttcataaaataacttaaacgtttcccatgaaactttgacattggtgtcttcatcatcacaggaccccattttgggtctcctaacaggtttcagagctcatcatccttccacatgactgtgtcgtgagatgtattktctagtcgtttttatcccaagccacaatgactaatttattcagcactaaaaattaactttttaaaagaaatctttagaagattgtgtacaaaactgtccagcactc

SEQ ID NO: 34694 - DNA, 273 bp, Homo sapiens
  misc_feature 21: k=g or t
  misc_feature 77: r=a or g
  misc_feature 81: h=a or c or t
  misc_feature 101: r=a or g
  misc_feature 109: v=a or c or g
  misc_feature 112: r=a or g
  misc_feature 132: r=a or g
  misc_feature 136: r=a or g
  misc_feature 139: r=a or g
  misc_feature 140: s=g or c
  misc_feature 143: r=a or g
  misc_feature 161: s=g or c
  misc_feature 177: r=a or g
  misc_feature 179: r=a or g
  misc_feature 183: r=a or g
  misc_feature 186: r=a or g
  misc_feature 190: r=a or g
  misc_feature 228: v=a or c or g
ctatgaaaggcacagatcaakgagcctgtccagtaacagatcaaggactgcatctaccgggactgaccgggtgagaratghaaagcctggagggaaacgaraatacaavacrcggcatttggagggtactarcgartgrstcrgccatctcgtgaatttgsttctaaagcaaagggrcrgtcrttrccaraaatcttcatcaaaattggatggaaactacaaaaatgvgagtgataccttttcagacagccgatcatcagacagagagacaga

SEQ ID NO: 34695 - DNA, 189 bp, Homo sapiens
  misc_feature 138: m=a or c
  misc_feature 166: s=g or c
atctatttttcattgtgggagagcccaggttgtcctgcttatctgaaattaagcccaaatcctaaaatttctgaatacctgctgtcagcttcctgcaaacgggccaggttgcctaaggaatgtcatgagagagctggmagaggcaggggacaggacaggcaccagsaaacaccacttcaccatgcgagc

SEQ ID NO: 34696 - DNA, 159 bp, Homo sapiens
  misc_feature 19: b=c or g or t
  misc_feature 116: r=a or g
aaagaacattccacgcagbagggaaccgcttgtgcaaaggccccaagactgcaagaacatcctgaagagggtagaagagaggtctgagcgggagtgcactgctttggatgctcacragggagctggaaatggtggtggaaggcatgcaacgagggcgga

SEQ ID NO: 34697 - DNA, 107 bp, Homo sapiens
cctgaactcatatttaatctctactgccagggaaatgctacattatttttctaattggaagtataattagagtgatgttggtagggtagaaaaagagggagtcccct

SEQ ID NO: 34698 - DNA, 444 bp, Homo sapiens
  misc_feature 128: r=a or g
  misc_feature 242: d=a or g or t
  misc_feature 420: d=a or g or t
atgggtccctgagacttggcgaagtaggagccctgtgtgatcgtgcgtcagagtcggggctgagaccagccctggccagggcagttaccaggacggtctccggaggccgggattcgcggagggtccarccagcaggaagaaaccccaggaggaagaaacctcagacagatcgccggggaggcagcgcgggatcccagcctcaggcgtgcgcggacggtgtgcggagtctagctttgtaccadgctgcagtgcagtagtgccatctcagctcactgcaacctctgcctcccgggttcaagcgattgtcctgcctcagcctcccgagtagctgggattacagccacatgccaccacacccagctaatgtttgtatttttagtagatacggggtttcatcatgttgcccaggatggtcttaadttcctgacctcgtgatccgccccc

SEQ ID NO: 34699 - DNA, 236 bp, Homo sapiens
  misc_feature 182: m=a or c
  misc_feature 183: n=a, g, c or t
caaaacaatcttgaaaaagaacaaagttggaagtctcatttgttgattttcaaaacttactgaaatgctataataatcaaaactgtgtggtattgacttaaagggagacatatagatcaaggaacgggaatggaaagcccagaaataaactcttttatacatggtaagatgattttagacamnggtaccaggaccattcaatgggaaaggatggtgttttcaataaatgatgaggg

SEQ ID NO: 34700 - DNA, 230 bp, Homo sapiens
  misc_feature 135: s=g or c
  misc_feature 165: r=a or g
  misc_feature 181: n=a, g, c or t
taaggatgggcatttagactgtttacaatttttagcaatacaaataaagtagcaatgagcatctgtgcacaagtctttataaaaatatggccacgtgcggtggctcacgcctgtaatcccagcactttgggaggsccaaggggggtggatcacctgaggttaggrgttcaagaccagcctngctaacacggtgaaaccttgtctctactcaaaatacaaaaaaaaaaaaa

SEQ ID NO: 34701 - DNA, 500 bp, Homo sapiens
  misc_feature 160: n=a, g, c or t
  misc_feature 297: n=a, g, c or t
  misc_feature 415: h=a or c or t
  misc_feature 459: r=a or g
ataacataatatatttattgtctgaaaggaataaatacttttgcttttcttactgaggtataagatgtaaacaccttaaacttttcttcccttgtatgaacactgtgtttgcataattttgctgaattattctaccacctagttatagtttcaaaagccnagttaataactctgacatagaaattaaagcttaaacccagtgactccaagctaagccttttgcaggcttgagcctgcaaaaggaggtttttaaagacccacttagttccttctggggagcctcccctgcagatgtcncagcttgctcacctcagctatggaagaagcccctatactgagacaatctacagagccctggaaagctggcaacccacacgcagatgcagttaagattaatataaaagggtattgggahggtcttactgaagatgaagttattgttttgaggcagtttctagrctttttaaataaaagttagatgtatgtaaaacttgaattca

SEQ ID NO: 34702 - DNA, 119 bp, Homo sapiens
caagttgtggggagccaggcttccctcacgcagcctgtggtggatgtgggaaggagatcaacttctcctcactctgggacagacgatgtatggaaactaaaaagaacatgcggcacaat

SEQ ID NO: 34703 - DNA, 121 bp, Homo sapiens
agactcctggaagtgagcggcctagcgagcgagctcccaggcgcaaagcacgccggaagctgtagttccgccatcggacggaagccgaccggggcgtgcggagggatgtggcccggaattg

SEQ ID NO: 34704 - DNA, 153 bp, Homo sapiens
ttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggat

SEQ ID NO: 34705 - DNA, 475 bp, Homo sapiens
  misc_feature 268: b=c or g or t
  misc_feature 319: w=a or t
  misc_feature 320: y=c or t
cactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcagagccacaagagtgtttaatggggacagtgggcactctcctgcttgaaaacccacttgggcagaatggactcacccabcaaggtcttctgtatgaagcagccaaggtgtttggccttcggagcaggaawytaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaa

SEQ ID NO: 34706 - DNA, 409 bp, Homo sapiens
aatagctcaaagatatcaaaaccaacatttctgaaatccccttggtctccccactatcctcagttacaagcatcatgttcacatttcaggaagaggacagaggaaggaagtggtgctaatgatactaattcaacccttgtgcctgggcaagagctttcccagaagccaccaaaaaagatttgtgttcctgtaccaagatatctatcacaggacaggtctccattgcaagaaaatctgacagaataagaaacaatctcaggataatgcagtgctagcccactaacaagggatggattcgaaaattaatccctggtctacatataccaaagtcaaaactcttctcataacacatgaccacccccatgaggagatggattgctacacaccagggaaacaaacacagtgcccc

SEQ ID NO: 34707 - DNA, 57 bp, Homo sapiens
  misc_feature 53: y=c or t
gcttgtgcatttgtcacgtagttctcatgcagtggttttcagctccatcaggycctt

SEQ ID NO: 34708 - DNA, 385 bp, Homo sapiens
  misc_feature 119: w=a or t
  misc_feature 120: k=g or t
  misc_feature 121: r=a or g
  misc_feature 128: w=a or t
  misc_feature 138: k=g or t
  misc_feature 218: r=a or g
  misc_feature 362: d=a or g or t
  misc_feature 363: k=g or t
ccattatatgaagtagacaaaattcaaatttatttattcatttattttctcaacaaatgaatatatattatgtgccaggatacaagtagtggcaaattagacacagttcttgctttcawkraaacgtwatagcttcakgatttagtatagacattgtcaaatcatcacccaaatataattacaaagtactctaaaggaaaggcacgtgatgctgtgaraacactcaactgggaaaccggaatcacctttgagaaactgtttcaggggctcttggaagagtctactgctcccaaatatctctgctacccactggccattgctttacattcctcaactaagctttcaccttttagtactaaccdktgatgactgatcaaatacaaat

SEQ ID NO: 34709 - DNA, 275 bp, Homo sapiens
  misc_feature 120: r=a or g
  misc_feature 124: s=g or c
  misc_feature 125: s=g or c
  misc_feature 130: d=a or g or t
  misc_feature 131: v=a or c or g
cataatcggcctttatgttacactgcctggccagcccctgttattctagtgcataattgatggtgctcacaagtggaaaagttagaaaagcggaagtaatgtgacgcagcagtgccatgragcssccggdvccccggcagtgagggcaatgcagagatgggctgctgctggctaccgccaggatgcctcagaagggcctgggcttacttggcatcttgtcaggagacttttcccttcttgctttgtccatgctgaaagggacaggaaaggtaggc

SEQ ID NO: 34710 - DNA, 298 bp, Homo sapiens
cagtctttcttcttttctcactaaattcttctttatatatcatagtaactagatgtagtctttttatcattcaattcttttctagtttgattttttcttcgacctatgtgttatctaaaaacacatttttaaattaacaaaatatgaggtttttctaattgtctttttgctattgatttcaaactttattgcattgtcctcagagactgtggcctgtatgataccacttctctgaaatatatttagacttacctgcccatgttatggtcaactttcctaagtatttcacaggtgccct

SEQ ID NO: 34711 - DNA, 345 bp, Homo sapiens
  misc_feature 230: n=a, g, c or t
  misc_feature 330: k=g or t
tcagagaagttatttgctcaaaattgttccactagtgtgtggcaagttgggattcaaacccagatcttctggctcctagaggtggaaaattttttactatattatgatgtattatagaaggaggtcaatggttatgccttgtagggtgcgtttgggaagtctgcgtctctgggccttcctgtatggtgtcttgccattgtagttacctgattctccctgatgtctgtccnagctggcctggctttgcactcagccctctcctgctccttgagcctctcctcctaataccatctttgcacacagctcagtctctgtaaaaccctgtcatgkatcctcctcggggtt

SEQ ID NO: 34712 - DNA, 174 bp, Homo sapiens
ccagattattcacaccgatagcaacaccgtcttgggccagaacgacacgggcttcagctgcgacggctcagccagcaccttccgcgtcatgttcaaggagccggtggaggtgctgcccaacgacaactacacggcctgtgccacgctcaagggcccagactcccactacggcgt

SEQ ID NO: 34713 - DNA, 185 bp, Homo sapiens
  misc_feature 129: m=a or c
  misc_feature 131: y=c or t
  misc_feature 132: b=c or g or t
  misc_feature 134: y=c or t
  misc_feature 146: y=c or t
  misc_feature 148: m=a or c
  misc_feature 152: s=g or c
tgcatgtttggagtttgtagtgggtggtttgtaaaactggaccattctgccttgctatgggttgttcaagaaagcctcattcttttctgtgaccctttcgcttttgcattcaccctccttcccacctamcybgycctggggctgtygmgcascataataatcccgggagaatgattcccctccga

SEQ ID NO: 34714 - DNA, 420 bp, Homo sapiens
  misc_feature 128: w=a or t
ccaccagttgcgtaggcttatatgaacctaaagaaagcatattacgctggaaataatagacttggcaatcattctctttgtatatgatatttgaaactatggcagttgatggaagtacctagtgaaawtgtcctggagaagtatcagcatttcacaaacctcagcaaatcaaactgaagaagagcagctaaaaagtagaacataagtaaagatctggcattcacaaaacccccaaacagcctgtttcaagaacgtatattgtgccaaagcctggctctgtaaagggccactgggttcaggaaagcagtcaatggtgatcttgacaaaaatgatgtctgtagtgaggttggaagtttgatgcagtgagtacaggtctaagtgtgttgcgaggaaatcaagactgtgaatacaaaagctctt

SEQ ID NO: 34715 - DNA, 124 bp, Homo sapiens
atatctgaatatgtgggcaggagtcaaaaatttttagctactttaaagtcaaactaaagtagcttcaaaaagacttctcaagatgcagtatggcctgctgaggtttttttgttttttttttttt

SEQ ID NO: 34716 - DNA, 78 bp, Homo sapiens
ttaattttcctccgttcttttcttctcttgcaaccacctctcttttacgtgtgcatctttctttttcttttttttttt

SEQ ID NO: 34717 - DNA, 123 bp, Homo sapiens
tagatggaaatatactttatattttgtatcatcgtgcctatagccgctgccaccgtgtataaatcctggtgtctgctccttatcctggacatgaatgtattgtacactgacgcgtccccactc

SEQ ID NO: 34718 - DNA, 172 bp, Homo sapiens
taaaaattagccaggtgtgatggtgtatgcctatagtcctagttattcaggagcctgaggcagaaggatcacttgagctgaggagtttaaggttgcagtgacctatgattgtgccactgcatttctagcctgggtgacagagtaagactctgtctcaaaaaaaaaaaaaaaa

SEQ ID NO: 34719 - DNA, 226 bp, Homo sapiens
caaattgtccctgtttgcggatgacatgaatgtatagctgtaggtttttgaagatgttgtcaagctgagggagttcccctctattctatttttgtgagagctttatattttttaaagtaacaacaattctacacatctcttccagaaaatagaagtggagaaaatatttcctaattcactttatgaagcttgttttacaccaaaaccagacagagagtacacacac

SEQ ID NO: 34720 - DNA, 340 bp, Homo sapiens
acatctgtctaccgtctgataactagccctagttgagttttatgaaagcagggaccttatttatcttgttcacactttatccccaacgcctagaactctgcttggcacatagtagctgctcagacaatatttgctgattaaataagtgaatcctgcatctcaaaagaaggtcttcaaatctcaaaagcaatatacatctgtagataaacttgtgaagggaacacattcctaactatcaagtccttagtctgagcttctcagggtcactctgggaacttatcagattcacaaggaccgggctgtatgctcgaagaaggagaaaacggggtttgctacctct

SEQ ID NO: 34721 - DNA, 200 bp, Homo sapiens
  misc_feature 135: k=g or t
  misc_feature 150: r=a or g
ctttagtgaaaaaaaaatgtctttaagtcccttttgtatgttattagtatagccacttagctcttttttgattattgtttgcatggtatcttttttcaccctttaactttcattgtatctctgaatctaaagtgkggttcctggtaaacrgcatatagtgggatcgtgtttcttatctgtcctgctggtctctgccgcga

SEQ ID NO: 34722 - DNA, 481 bp, Homo sapiens
  misc_feature 133: r=a or g
  misc_feature 137: r=a or g
  misc_feature 138: w=a or t
aattatagagtgctataggaataaaggaaaaggggattcattttgactgaagagatacaggaggatgaaactgggttagctcttgaaagaagagaactatgacaacaattgctgtgggtaacaatatcccagrccgrwtagaataccttggacctaagcaaccaggatgattgtgcctttaagtgaaagagaagaacaggaagaacagagatggggtctttctatgttgcccaggctggtcttgaactcctgactacaagtgatcctctgacctcagcctcgcaaagcgctggtattacagctccctccatcaggaaacttaagaccaactccatttgatctgatcagaggacgtctataaggaccaacacagtgtcacattcaaaagcatctttctccccctccaatcaaccagtgtcctggggccttcttacctctggaatagaatccatgaaactgaaaatggttagacaaatggagc

SEQ ID NO: 34723 - DNA, 436 bp, Homo sapiens
  misc_feature 143: k=g or t
  misc_feature 146: r=a or g
  misc_feature 148: k=g or t
  misc_feature 152: s=g or c
  misc_feature 158: k=g or t
  misc_feature 160: r=a or g
  misc_feature 192: k=g or t
  misc_feature 195: n=a, g, c or t
  misc_feature 196: h=a or c or t
  misc_feature 197: n=a, g, c or t
  misc_feature 327: m=a or c
  misc_feature 328: n=a, g, c or t
  misc_feature 345: k=g or t
  misc_feature 388: k=g or t
cctgagtagctgggattacaggcatatgccaccatgcctggctaatttttgtatttttagtagagatggggtttcaccatgttgatcaggctggtctggaactactgacctcaggccacccgccttggcctcccaaagtgctkggraktacsaggcakgragccaccgcgcccagctaatttttgtattttkatnhnatttatttatttattttttgggagacggagtcttgctctgtcacccaggctggagtgcagttgtgcgatcttggctcactgcaacctcagcctcccaagtagctgggattacaggcatgcaccatcatgmncagctaatttttgtatktttagtagagatggggtttcactgtgttggccaggctggtctkgaactcctgacctcaggtgatccaccggcctcagcctcccaaagtgct

SEQ ID NO: 34724 - DNA, 383 bp, Homo sapiens
  misc_feature 156: k=g or t
  misc_feature 271: n=a, g, c or t
ttatcagttagttaacagaacttctatttaaatctagtagtatataattctctttctgtgacagagtataaatatgctcatttgaactctgggagaaggaaagctggtgcgtattagcttgccttaagtggctagagactgttttggtgtgaatckgtgtaaaatttgaagaagataatattgtatgttttactagagtaaaaacttaattttagtgcagagtggctattggggtgataaggaagaatattgtatttttccataggtcccnaggttttttgagacaacttgagtgtcagataaggtacttgggatcattaggaggcttaataatcattttagggtttgtgtgtgttaaagaaccttactgactggctagctat

SEQ ID NO: 34725 - DNA, 473 bp, Homo sapiens
aagtcctattggatttcacctgcaaaacacaagttcaaaggtaagattatgagtttcctgatggcgacagcagagcatgatagcaaactcaggtctttctaagcatggggttctgtgccactgcacaggttcatgcccataaagcgctcctgatctaagtggtacttgagaggtgttagtatcgcctgttccaggcactgctgaatagagcaggagttccagacagagtcctgctcttttactatgaaatcacagtgcagttgggggatgtgagtttatgtattcaataattcatttcagtagcattttccatgctaagtcctgtacattagatatatcaaatatgcgggatctgcagtgagagtccatgctctgagatgtgtgtgaacgtgcatgcgttagatgtgtgaagggcttgaatggctcaaatccaatacaaagcagcaataatgaaatagactacacgttgatgt

SEQ ID NO: 34726 - DNA, 370 bp, Homo sapiens
taaatttaggctgtgtgtgtgtgtgtgtctgtgcacacgtaggtgtggtagaattttttttccctactaaagtaatcggagactctgcctgaaattctgtaattttgaggtcttgttgtgttagaaggttgcctacagtgggaaacttgtctttttctgaaattaaaaaaaattattttccaagttcctctccaacctttgccagtctgtgttgacttactccttattaaacgctcagctctttaaggcccattagtcaagctgttacttgtgtgcaggcctgaagcagcagttctgtcagtgagcctgcacctacctgcaacaccccatttggttgtctgcacctggacttgtctcctaatcataatat

SEQ ID NO: 34727 - DNA, 265 bp, Homo sapiens
  misc_feature 127: m=a or c
  misc_feature 210: w=a or t
gtggacctgcaggtacttggatctccagtgggagctgccctctcgaaggcaggacagcggtggcggcagatataaagacctgaagatagtcttttctgtccaaagatggaaaacagtactactaacmatttctcgggaggagcttgaagaactacaagaggcatttaataaaatagatattgacaatagtgggtatgtcagtgactatgwacttcaagacctgtttaaggaagcaagccttcctctgcctggctacaaggtgcgc

SEQ ID NO: 34728 - DNA, 188 bp, Homo sapiens
  misc_feature 117: r=a or g
  misc_feature 121: r=a or g
tgcctctgctggatgccttgttctggacttcttgcttgtcctgcccccgttggttgccccaccaccccttccgcgcccaggggactctggctcttgttgctactctgcagaccaggrgagraaacctccatcccaggaggaaatgtatttggttagaaggtttgtaacaatgtaattatgcagctatt

SEQ ID NO: 34729 - DNA, 111 bp, Homo sapiens
catttatttttaatttctaaatttcttttgaaataaactaaatacaatcatgctctgcataatgacatttcagtcactgatggatcacatatacgatagttgtcccataaa

SEQ ID NO: 34730 - DNA, 385 bp, Homo sapiens
  misc_feature 141: r=a or g
catttttaagtatacagttctgtcatgaagtatagtcacattgttgtgcaactggcagtctttcatttggggacttttgtggtttgatgaggtacaagaaataaaaggagggcagacaggaatgcaagtcagtctgttgtragaagagactgcattggggtccagaagctgagtgctagttctgggtccaccctacagtgtggcagttataactcgacttcttttttctggagtgtgacaggagagtaacagcagtgccacctgtctcatggatgctgtaagaacctcacggagcagcatctgtgggtacacgttgaacatcagagtgcagcgtctggctaagggattattttcagaacagttaattgttacatgatgggggtac

SEQ ID NO: 34731 - DNA, 137 bp, Homo sapiens
atatatatctttcctggtagactgtcttacagttttttgagtaacattttatacttggatttttctgttgggttggactaatctggctgttcgcaagtgtgcactatagtgttttttatctgtactggaggactaag

SEQ ID NO: 34732 - DNA, 98 bp, Homo sapiens
ttaactgcatgataaaaatgctgcaaacactatttagttgccaacagtaagaaatttacttgattttcttgattttcttttctttttttttttttttt

SEQ ID NO: 34733 - DNA, 375 bp, Homo sapiens
  misc_feature 46: r=a or g
  misc_feature 47: r=a or g
  misc_feature 170: n=a, g, c or t
ttttacaacatgtggttttaagtgtgtatcttacatttaaaaattrratatacaaataatatatgctcgtagaaaatgcagaagacacatgaaaaagaaataaaaaaaactcgatccctttaaaagactaacacaaattcacattttgctttactgccttccaacatttncctaagcataattttttttgttttgccatatatgatgataatcaccatatatattcagttgtaaatgctgttttttccacttcgcattttaagatagctggaaaccatcattctcagcaaactatcacaaggacagaaaaccaaacaccacatgttctcattcacaggtgggaattgaacaatgagaacacttggacacagggat

SEQ ID NO: 34734 - DNA, 237 bp, Homo sapiens
tcagaggcactgcttgctttggccccaaaaccctggtgcaggacctaggggacgtagggcggcaggacgaacattggcccggccctcgcctcctcctgtgaccccgcaacccctcacctcccgcggggagaaagaaggcgtaagtgtatgttttaactggaaaaagtcttccatgaaaacgtcacttttaaaaaataagtaatgccatctgttttcctaaaagactgaaaggggggc

SEQ ID NO: 34735 - DNA, 219 bp, Homo sapiens
  misc_feature 129: s=g or c
  misc_feature 149: s=g or c
  misc_feature 156: n=a, g, c or t
cttttaatttttaaaatttttaaattttaaattaaaaaatggtattttttgagacaaggtctcactctgctactcaggctggagtgcagtggtgcggtcatagctcactgcagcctccagctcctgggstcaagtgatcctcctgcctsagcctcntgagtagctgggactatgagtatgcatcaccaggcctggctaatttatttttccttttccatt

SEQ ID NO: 34736 - DNA, 137 bp, Homo sapiens
gtttgaatggccctgagtgggactcggcccagaagccgagggactctctaggctgccgggcgctggtcgtcagcgccgaggctgggctgaggcgccgcggtaccatgaggcgccggtacttaagagattatggcatc

SEQ ID NO: 34737 - DNA, 264 bp, Homo sapiens
  misc_feature 39: r=a or g
  misc_feature 125: s=g or c
  misc_feature 146: s=g or c
  misc_feature 148: m=a or c
  misc_feature 156: n=a, g, c or t
  misc_feature 224: w=a or t
  misc_feature 256: v=a or c or g
atgggctgtgggtgccgctgagcaagatggagctgtctrcagtgggcgagcgggtcttcgcggccgaatccatcatcaaacggcggatccgaaagggacgcatcgagtacctggtgaaatggaasgggtgggcgatcaagtacagsamttggggancccgaggagaacatcctggactcgcggctcattgcagccttcgaacaaaaggagagggagcgtgagcwgtatgggcccaagaagaggggacccaaacccvaaactttc

SEQ ID NO: 34738 - DNA, 412 bp, Homo sapiens
  misc_feature 138: s=g or c
  misc_feature 338: n=a, g, c or t
  misc_feature 339: r=a or g
aatgcgtgggtgaggcgagggctaaacgggcggaatgaactgggagtaagatgctgccgagtccgggcgaaaagcaacgcatgctgttggacaggatacgagcttgaaatccgggtcttcctccagcagctcaagggscggccgtacccgggaggccattcagaaagtgcatccgggtggccttcagggaccaaggcgccgggaggcacagcccccagcccccatagaggtctggacggatctggctgagaagataacagggccactggaagaagccgtggcagtggctttctcgcaggtgctcaccatcgcggccacggaaccggtcaccctccganractccaagccccccaagcccacgcaggcccgtggaaagcctttgctcctgagcgcccctggaggacaggaaga

SEQ ID NO: 34739 - DNA, 421 bp, Homo sapiens
actttagcctctgattgcaggccaccacttcatttacatggggtgagcaccaatgcgttttgttcaattctttgttcaaaaccccaagaatctggacaacttgcactcaagaccctctacgggtttggcgagccagtccttcagtggctgttttctagtagctccttggcaattgaggggaactggctgggaccactctccagtgctgtctgaaggccaaggagtgaacagggatggctgccctgccttgaagagggaaggactcttttctatcctttccagctatagtccctgatccctacatgtgatgcggttggcagcggaagctcatcctgggcgaactcacacacttttcaggagacttaaaccttttcttatgctaagttcttcccttcccctactcatctggctaaaggacaga

SEQ ID NO: 34740 - DNA, 110 bp, Homo sapiens
agggctgctggaccgggcctcctgcgggccagacgcaatcgaacccggacgcgctgccgccagactactcggtggtgcgcggctgcacaactgacaaatgcaacgcccgc

SEQ ID NO: 34741 - DNA, 260 bp, Homo sapiens
caccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccc

SEQ ID NO: 34742 - DNA, 134 bp, Homo sapiens
tctttgttcacaattcagttcctcccaaccaaccagtcttcacttcaagagggccacactgcaacctcagcttaacatgaataacaaagactggctcaggagcagggcttgcccaggcatggtggatcaccgga

SEQ ID NO: 34743 - DNA, 261 bp, Homo sapiens
gtattgaaaaagaacaggtaacaagagggctcaagaaagcttcacaaagggggaacaagctggtcttaaaaggtaaagagaagtttgtcaggagtagaagggatggaaaagcatttcaaataaaaggagcagcttgtacaaagcagaaaagtgtgtgccaaggaatgatatgaactcatgaacttcagtgtgagtggactatagggaacagtgttataaaatgaagctggagaagaaggttggcctgagattgcaagggga

SEQ ID NO: 34744 - DNA, 316 bp, Homo sapiens
  misc_feature 298: d=a or g or t
  misc_feature 313: k=g or t
cttccggttctttgtgcggccttcacccagtgagggagcctgtgccccctgcccagtcgctttcggggcgctgaggagcttccgctgccatcttcggatgctgtgtcccgcacggagggtccaccagggcagggatagtggtgagggtcgctcgtggatcccctcgcggggagcagggtctggcacacaccagggcgcaggattaggacttgttgaatgaatccatcatggcctttatcttttagtcctctgaagagcgttgagaatggaaatcataagatattttttccattaggadgttctttttacaagkcgc

SEQ ID NO: 34745 - DNA, 147 bp, Homo sapiens
ctttgggaggcggaggctggcagatcacctgaggttgggagttcaagatcagcctgaccaacatggagaaacccccgtctctactaaaaatagaaaattagctgggcatggtggcacgtgcctgtattcccagctactcaggaggcg

SEQ ID NO: 34746 - DNA, 192 bp, Homo sapiens
  misc_feature 16: k=g or t
  misc_feature 23: s=g or c
  misc_feature 99: y=c or t
  misc_feature 100: s=g or c
aaggtaccatttctakaataaasagtatgcaaaatttttgcttatttctctatactctcagcaacactggtattttctaatttgagaagttaatatgcysatcgtattgtttaatttaatgtttatttggttaccaatattgatggacatttggatattcatctttggatcatgaagttaccttaggccctt

SEQ ID NO: 34747 - DNA, 139 bp, Homo sapiens
attttatgtttatttatctttcctctgtcattatttataattttatcacacatggctgtatcctttacatgttttggcattatgtatttttgaacttttttgtaaagacaatcataccatgtgtaattttcagggacac

SEQ ID NO: 34748 - DNA, 176 bp, Homo sapiens
ttgtatttttagtagagagggggtttcaccatgttggccaggctggtctcaaactcctgacctcagatgatctgcccgcctcagcctaccatcccactcctaaatgtgctcagcctatcctcccagcatatatatttattgtgtgcaaaaaccgcaataaagactctggcccacgc

SEQ ID NO: 34749 - DNA, 127 bp, Homo sapiens
  misc_feature 10: w=a or t
acaggttatwtcttttccatgccttaaaatgccagctaaaacccttaggacaatgttacatagaagtagcgaaagtcattgggtgcccatgagttgtttctgactttacaaaaaatgcattcaatgt

SEQ ID NO: 34750 - DNA, 122 bp, Homo sapiens
  misc_feature 93: r=a or g
tgcccgactctgtctcttctctccatctccaacaccactgcctcatccaagttaccatcatcatttcgtctgctcagttgttgaggtctcctrcgagtgtccccatattctgcggcccctcc

SEQ ID NO: 34751 - DNA, 152 bp, Homo sapiens
  misc_feature 79: k=g or t
  misc_feature 95: k=g or t
  misc_feature 110: k=g or t
ctcaagtccctgaaatccctgttagaagagtctttccactggttgggaatgctaattgtattttgacaactcaatgttkcagcaactcaaaatgktacagcttctgcatkggaataaaaaaaggaaagaaaacagaatttgtactcatatca

SEQ ID NO: 34752 - DNA, 78 bp, Homo sapiens
  misc_feature 50: r=a or g
agagacagctttggctatgggagaaggaggaggccgggggaaggaggagrcaggaggaggagggaccacggggtggag

SEQ ID NO: 34753 - DNA, 176 bp, Homo sapiens
  misc_feature 86: r=a or g
  misc_feature 87: d=a or g or t
  misc_feature 90: r=a or g
ctttccttctgtttctccttctagaagatccgcttccagtacccaccctcaacccgagagcttttccggctcctgtgctctgcccrdtgrggccccggggccagccccctcccttctgctgctcgacggcctagaagagtacctagcggaagacccagagccccaggaagccgcca

SEQ ID NO: 34754 - DNA, 51 bp, Homo sapiens
tctctgcagtgggagcagctctcctgccacagctcctcaccccctgaaaat

SEQ ID NO: 34755 - DNA, 309 bp, Homo sapiens
  misc_feature 112: y=c or t
  misc_feature 118: m=a or c
aatttctggcacagaccgcctagcagtgctgcctgggaactaacacgtgcctcgtaaaggtccccaatgtaatgactgagcagaaaatcaatcactttctcctttggctttyagaggmtagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatct

SEQ ID NO: 34756 - DNA, 209 bp, Homo sapiens
  misc_feature 196: m=a or c
ctatagagttaatttgtcactctgctctttggggaataaatattagtatacaacctgtattactttaataaagaaattatttctttagttttgattcttcaggatgattcaattccctggtgagagaataacttacttattaaggtaatagatgtagggaagactcattactcttgaccaacatctcccccaccamcagccccaggcgc

SEQ ID NO: 34757 - DNA, 357 bp, Homo sapiens
tgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcattaaataccgacatattacataccccatgtaaaattttgcttaaactctctagcacttggcatgtagaatatgtaccataggtatcaggttaaaacactaaagtctgccagaaac

SEQ ID NO: 34758 - DNA, 239 bp, Homo sapiens
aaagttggtgaaatacttaccttatgtctggaaatacagataatgtgatttttaaaaaacacattgagccccgttttacttctgtggtatggtaaaggcacaggtttattcaatgaaaatcagacgttaaccatctaatgcaggggtggccaatcttttggcttcccgggaccacattggaagaattggcttgggccacacataaaatacgctaacagtaacaatagctgatgagccta

SEQ ID NO: 34759 - DNA, 274 bp, Homo sapiens
  misc_feature 95: r=a or g
  misc_feature 240: r=a or g
  misc_feature 241: r=a or g
taaagaattttcaacccagaatttcatatctagccaaactaagcttcataagtaaaggaaaaataaaatcctttacagacaagcaaatgcttgaraagattttgtcaccaccaggcctgccttacgagagctcctaaaggaagcactaaacatggaaaggaacaactggtaccagccactgcaaaaacatgccaaattgtaaagaccatcgatgctatgaagaaactgcatgaattaacrrgcaaaataaccagcgaacatcataatgacagga

SEQ ID NO: 34760 - DNA, 207 bp, Homo sapiens
tagaatatgatttgtgctctatgcattgtgtaaccttgactgccatgtaagaagtatatgagctgggcacggtggctcatgccttcaatcccaggaactttgggaggctgaggcaggcggatcacccaaggtcagaagtttgagaccaacctggctaacatggtgaaaccccgtctctactaaaaatacaaaaattagccgggtatg

SEQ ID NO: 34761 - DNA, 265 bp, Homo sapiens
cagatttaaaaaacttaaagctaagtaaatccaagtaaatttaatgtattatgtggaaatggattctgtctgcttcttaggcatctatccagataagatttagaatacaattggtagagtttttacttgtgatgttgctttgtttcagtatgaaggctatgaagtagagtcatctttaaaggatgccagctttgagaaggaggcaacagaagcacaaagtttggaggtagaaaatcaaatggtataattttaaaagctgggggct

SEQ ID NO: 34762 - DNA, 270 bp, Homo sapiens
  misc_feature 126: n=a, g, c or t
gattttgaatctttttggtaccttttggttaatgacatagcctcctgaaattctggatgtcttcaaagtcagttttgcttctttatcctgaaaatcagatttacaatgctgaaggcatttcttggncccagtgtagctcacgcaatctctgctacccataagccttgatgaagatgatacagtccggactgtgagcatggtgcttcatgtatatgtgctgccagtaacaagaatttttttgttttgttttgttttgttttgataaggcat

SEQ ID NO: 34763 - DNA, 188 bp, Homo sapiens
  misc_feature 44: m=a or c
aaggagaacaaaccaagttacatccactaccagcctgcccaggmccggctgcaaccccacctcctggagatgctgattcagctgccggccaactcagtcaccaaggtttccatccagtttgagcgggcgctgctgaagtggaccgagtacacaccagatcctaaccatggcttcgatgtcagccccta

SEQ ID NO: 34764 - DNA, 346 bp, Homo sapiens
agtttcccacctcttccctcagtatttctactagtggcttctcatctgatcaaaggaacagagaggtttacactgacctaacaaaaggatcttagtaaattattcctgctggagaggaattacaattataatgataattcctggaggggatgtcccgctgaagattccaattataatgctgttatttagcttctgctaagagaagaactaaaggtcaccccggtcatcttttgggagggtagcacccccttgaagatgtgtttggagggtggcccatggagttctgctgctgggaagatacagactggagtatcatcagactgagtcaagcagcaggagccccctt

SEQ ID NO: 34765 - DNA, 90 bp, Homo sapiens
aactggatacacgcaaaaagaaagaatgagcatgtcagacaagaacttttacctcgtggccctggtgaaggtaggaaaaaaaaaaaaaaa

SEQ ID NO: 34766 - DNA, 238 bp, Homo sapiens
  misc_feature 198: b=c or g or t
tttctttcctggtgagactttgccccaagggctgctgtgagccaagcgtcttccgcagtcttccctccctgtgttttgagctgttccccagcctctcatgacagtgctgcatttatctcactgttagtcagtattctgaatctgcaatcaccaccaaaacaaatgcaccatctaaattactgttatcatctaagaacbtaagtttatatgcaacaaaggtatatgtgtatgtgtccgt

SEQ ID NO: 34767 - DNA, 93 bp, Homo sapiens
  misc_feature 72: k=g or t
  misc_feature 84: k=g or t
gtataatattgagccacatattcttcacagtatattttgctcatacctactgcagacttacacatgacagckgaattgcaaackgtaaatggc

SEQ ID NO: 34768 - DNA, 281 bp, Homo sapiens
  misc_feature 235: s=g or c
gatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttsgattttctgtaagtgtttaatttagttctaggggacagcatccctc

SEQ ID NO: 34769 - DNA, 331 bp, Homo sapiens
  misc_feature 157: w=a or t
  misc_feature 158: r=a or g
  misc_feature 329: m=a or c
caaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttctwrcagagagcctataaatggacgtgcaagtaggagagatattgctaaattcttttcctagcaaggaatataatactaagaccctagggaaagaattgcattcctggggggaggtctataaacggccgctctgggagtatctgtcctatgtggttgagataaggactgagatamgc

SEQ ID NO: 34770 - DNA, 146 bp, Homo sapiens
  misc_feature 32: m=a or c
  misc_feature 61: h=a or c or t
  misc_feature 67: s=g or c
  misc_feature 72: m=a or c
  misc_feature 111: s=g or c
  misc_feature 112: s=g or c
  misc_feature 113: y=c or t
  misc_feature 114: s=g or c
tgagtgaatccatttgtgagagagcgaatggmgatgacaagattagctaggagactggcahaaagascaggmacctgcactagggcaaaggccagtaggaatagattggassysttaaggtgtgaactgttaaggtaagatgataa

SEQ ID NO: 34771 - DNA, 150 bp, Homo sapiens
cgatcagtactattcccttgttgttagtaatacgattgaaaatctagtgtttaaatatattgagagtgctcaaactttggatcacagaagaacttttaaaagtaacttaagccaacaatattatgtgctaactaaaacactggggaggcc

SEQ ID NO: 34772 - DNA, 399 bp, Homo sapiens
  misc_feature 302: d=a or g or t
acgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcdtgagaatatgtagcagtggtcttgtcaaattgtggagctctttgaccctgttaggatcctataaaggcaaaaaatgtgctttccgggtgattcaggt

SEQ ID NO: 34773 - DNA, 202 bp, Homo sapiens
  misc_feature 86: k=g or t
  misc_feature 90: r=a or g
  misc_feature 99: r=a or g
  misc_feature 114: s=g or c
  misc_feature 184: r=a or g
tgtcaggtacataacataaaacagattgggaatttattgtttccaaagggcatggccttccttagcatcagtttgaagcttttgtkatgrcttagctgrcttgtggcagcggasaagcaaaaacaataacactgcttataaatggcaccacatcttgttaacctcccccccaaatactctctgraagtcatgcacatacaca

SEQ ID NO: 34774 - DNA, 413 bp, Homo sapiens
  misc_feature 255: d=a or g or t
  misc_feature 256: k=g or t
  misc_feature 345: w=a or t
  misc_feature 397: r=a or g
ttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctatggccatctttatttgtgtattaggcaattcgtatttcccccttaggttctagccttctggatcccagccagtgacctagdkcttagcctcaggccctgtcactgagctgaaggtagtagctgatccacagaagttcagtaaacaaggaccagatttctgcttctccaggwgaagaagccagccaacccctctcttcaaacacactgagagactacagtccgrctttccctcttacatc

SEQ ID NO: 34775 - DNA, 296 bp, Homo sapiens
  misc_feature 99: m=a or c
  misc_feature 107: r=a or g
  misc_feature 175: w=a or t
  misc_feature 187: y=c or t
atcaaaattggtaaggacaaagttaaattttccttgtttgctgatgacatgattatatatagagaaaatcctaaaggctccatcaaaaacctgttagamataataarcagattgagtaaatttacaggatacaaaatcaacatgcaaaatctgtagttttttgttttgttttgtwtttttgtttgtytgttttttgagacggtagtctcgctctgtcaccaggctggagtgcagtggcgcgatcttggctcactgcaacctccacctcccggtttcaagggattcttctgccttat

SEQ ID NO: 34776 - DNA, 313 bp, Homo sapiens
  misc_feature 206: r=a or g
  misc_feature 265: k=g or t
  misc_feature 279: k=g or t
caattcttagtgaaaattttgttctttcatctgtattctggtcagccagcttgaagtagacacaggcagatgcttggagagtcgaaattatagccgaatgatatcacagagtagttaaataccagccaagctgtggttgcagcatggcaactttacaagccgggcaggttagcatggatgctgtgaaaagtgacccctctatctgraaaagggttttgtaccttggctggcattagtcacttttccttgtttgatatttacagckttctcttgtccttkgtatcctttgggtaacacaccgtgagtgagagca

SEQ ID NO: 34777 - DNA, 168 bp, Homo sapiens
tctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagacacgccgc

SEQ ID NO: 34778 - DNA, 312 bp, Homo sapiens
  misc_feature 221: y=c or t
  misc_feature 297: k=g or t
ttccgttcttaccagcagtgtgtgagagttctagttgttccatttcctcaccaacacttggtaaaatcagtctttttctttttaaggctgttctagtagatgtgtgttgatatcacactatagctttatttacacacacacacacacacacacacacatagccattcccccattctttccattatagttacatcaaaatattggttgttcggggtgtaacytcctatggctgtgtacacactcttcatggctgattctcatatagtatgatttccttccctttcctaagtaactgtktgttttctgtagagt

SEQ ID NO: 34779 - DNA, 89 bp, Homo sapiens
  misc_feature 62: r=a or g
gaaaagaaaaaaaagtcacccaaagccgccccaagtgcaggcaaacagaccttgctgactgraggcaaagactcctccatcccacctac

SEQ ID NO: 34780 - DNA, 250 bp, Homo sapiens
  misc_feature 166: m=a or c
  misc_feature 203: m=a or c
  misc_feature 204: m=a or c
  misc_feature 205: m=a or c
gttgcttcccaggagcacgagctggggcagggaccactgcacggcctgacccttggagctgactgcccgcctgcctgctggcaggactgaggtgagctgactgaatgccccaccccaccatgtgcttcaatccctaggctctgcagcagccgcccccacctgtgamatgttaagagctcatggccacgatgacctctactttmmmtgggaaccttgtgcctcctcccaagctatcactgtgctcccggct

SEQ ID NO: 34781 - DNA, 453 bp, Homo sapiens
  misc_feature 71: m=a or c
  misc_feature 94: s=g or c
  misc_feature 96: n=a, g, c or t
ggtttgccctgccgagtttaggctggaaaacgtgttcagtttctcctgaagagggaaggggtgaaagagamagatgcccgacgcgccgggaggsgntcccctctggcagaggtgccgggtgaggagcccgaagtcacgcggatgaaatatcggttttgatttattatcttcacttggaaagaaggacagcttcagaggcttcccattggctttccccaccatgataactcaagaccaaggaccctgcttcttaccaatgtggagattgctccagctgcccaatatgtactcccaattatgcactcaggaactaagaaaatgactactggatgggtcagtgtattcctggacccactgtaagctggacattatccaggactctgcttattacctgatccccataagcccccacacttagagaggagccatgtgtgttacatactttgggtaaca

SEQ ID NO: 34782 - DNA, 140 bp, Homo sapiens
  misc_feature 79: k=g or t
  misc_feature 81: k=g or t
cccacaattgacaatatatatgcatgtgtttaaaccaaatccagaaagcttaaacaatagagctgcataatagtattaktkaaagaatcacaactgtaaacatgagaataacttaaggattctagtttagttttttgtaa

SEQ ID NO: 34783 - DNA, 369 bp, Homo sapiens
  misc_feature 29: r=a or g
  misc_feature 30: v=a or c or g
  misc_feature 65: s=g or c
  misc_feature 66: k=g or t
  misc_feature 155: k=g or t
  misc_feature 160: k=g or t
  misc_feature 165: b=c or g or t
  misc_feature 168: w=a or t
  misc_feature 170: d=a or g or t
  misc_feature 177: m=a or c
  misc_feature 181: r=a or g
  misc_feature 195: m=a or c
  misc_feature 196: s=g or c
  misc_feature 216: v=a or c or g
tgacgttttagctcttaggaaaaatatarvacaaaacagtatgatatcattacctaagtaagtaskgctttacaggaattattataaaaagagaatgtctcacatataacttaccttactttattatgtcagtttcacagacatttgtttaatgkctgtkaggcbatwtdcttccamaaargtgctgggattatmsgtgtgagccaccgtgcccavcctgcctgcatcttgttaaagaatccctgactcaggggaagagagtgtggcctactttctgctccttgataaaccttccatgccattgatcttccatgatgaatgctccagttttgactctaaggccttgccacctgtttctatcaccacgca

SEQ ID NO: 34784 - DNA, 356 bp, Homo sapiens
  misc_feature 99: m=a or c
  misc_feature 141: m=a or c
  misc_feature 160: r=a or g
  misc_feature 256: m=a or c
tgaaccttgcttttatacaaatcacttttttgttatttgaggaacaagataacattttcttggcaggattactatagtccccccaacaagctctaccamagaagataatagaacttattgagcttaaatgaattataggamagttcctgaaaagtccaargtaaatgtgaagagaacccgattctcttaacctcacccaacccagcacttgattctcccttgtttcctggttttcatacacacactgggaaaggamaaggaagaagaaacaaggatgtcgttatggctgaaggagctttgagcttcctttgctctttatcgcaaaatgcattgaatatttccctcatttctcgtaa

SEQ ID NO: 34785 - DNA, 352 bp, Homo sapiens
cccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttcta

SEQ ID NO: 34786 - DNA, 365 bp, Homo sapiens
  misc_feature 88: k=g or t
  misc_feature 95: s=g or c
  misc_feature 96: k=g or t
  misc_feature 243: w=a or t
  misc_feature 330: r=a or g
  misc_feature 341: k=g or t
ttggttttttgttcttgcgatagtttactgagaatgatgatttccaatttcatccatgtccctacaaaggacatgaactcatcatttkttatggskgcataggtattccatggtgtatatgtgccacattttcttaatccagtctatcattgttggacatttgggttggttccaagtctttgctattgtgaatagtgccgcaataaacatacatgtgcatgtgtctttatagcagcatgattwatagtcctttgggtatatacccagtaatgggatggctaggtcaaatggtatttctagttctagacccctgaggaatcaccacactgrcttccacaatkgttgaactagtttacagtccggcc

SEQ ID NO: 34787 - DNA, 144 bp, Homo sapiens
agatatgaccatttctgccaacatccccgctcaccaggagccccttgccaggagtgttcaagatgctctctctggaccgatcccactgaagatgatgagaagcttattgaggaaatccagaaggaggctgaagaggaacagaaa

SEQ ID NO: 34788 - DNA, 283 bp, Homo sapiens
  misc_feature 72: m=a or c
  misc_feature 79: k=g or t
  misc_feature 81: k=g or t
  misc_feature 156: w=a or t
  misc_feature 168: w=a or t
caagtgtctgtgcacaggagtcagagagggggaaccgccgtcccaacatcacaaaaagtgaaagaagccggmagagatktkacctatttaatagtggtgctttttggaatcagcattacaggtggcttgttttacacgattttcaaagaacttttwtcttcatccagwcctagcaagatatatgggagagccttagaaaaatgcagatcacatcctgaggtgatcggtgtctttggtgagtctgttaaaggctatggggaggtgacaaggcggggtcgccggc

SEQ ID NO: 34789 - DNA, 308 bp, Homo sapiens
  misc_feature 2: s=g or c
  misc_feature 275: k=g or t
  misc_feature 285: v=a or c or g
tscacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttkggtaaggagvttttaagggagaaggtccagtcc

SEQ ID NO: 34790 - DNA, 139 bp, Homo sapiens
tgccctaatatgtattttttatgaggtggttcatgtcccactgaacaagactggtggaagctgcatgacttagtcttggaagacacaccgcaacacttccactgcactctatcagccagagcaatcacaagtccgccca

SEQ ID NO: 34791 - DNA, 320 bp, Homo sapiens
cgaaggaaaatagaatgcacatgccacttaaaccccctactaaaagttagaatctcaatttggatcaaaagcaaagtcacagctcctcaagaggctgaggcaggaggatggcttgagtccaggagttcaaggctgcaatgagctgcgatcacgcactgcactccagcctgagtgacagagaaagacactgtctctaaaaaaagattgcattttttatcactaggcaataaagtgagcaattaataacaaaaggataattttgaaagactaaaaaagtagagattgaaatactgtcttaaaataatttttagatcaaaaca

SEQ ID NO: 34792 - DNA, 139 bp, Homo sapiens
gaataatatgattaaatagaaggtttgtgccagtagacattatgttactaaatcagcactttaaaatctttggttctctaattcatatgaatttgctgtttgctctaatttctttgggctcttctaatttgagtggagc

SEQ ID NO: 34793 - DNA, 233 bp, Homo sapiens
  misc_feature 215: k=g or t
acttctccagcctggacggtacagcgagacttgtcttagggagggggggaaaaaaaacaacaaaaaaaacagaggctaagaggtaactccgaggatgacagaaaacaccagagtttttaggagatgttagaagccctgggagcactgaacaaaccagaaagctcccgacccttgatccctgagctccacctagcaagtaccgcggcagctaacckgggagaataccccaactt

SEQ ID NO: 34794 - DNA, 208 bp, Homo sapiens
caacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtctgc

SEQ ID NO: 34795 - DNA, 152 bp, Homo sapiens
gtcttgttcccgttctcagagggaatgctttcaactttaccccattcagtattatgttggctgtgggtttgtcatagatggcttttataacattaaggctggagtgcagtggcgtgatctcggctcactgcagcctctgcctcccgggccat

SEQ ID NO: 34796 - DNA, 162 bp, Homo sapiens
  misc_feature 47: w=a or t
  misc_feature 63: v=a or c or g
  misc_feature 130: d=a or g or t
cattaccaacaggcctacttctaagccaacaacaagacctacaccawagccaacaccaattcvtactccaccaccaccaccacccctgccaacagagctcagaacacctctaccacctacaaccccagadaggccaaccaccggactgacaactatagcacc

SEQ ID NO: 34797 - DNA, 157 bp, Homo sapiens
cctacttactatctttttctctgaatcaacttccagccaagtgggtttaatgtatatgcccctcctccaagttaaataaaaccatggtgatttgttgtttcctgccattatttcgtcggcttgtaataccccacctctttgttgcctatccccttcc

SEQ ID NO: 34798 - DNA, 233 bp, Homo sapiens
  misc_feature 141: v=a or c or g
  misc_feature 142: v=a or c or g
ttttccccattggaactagtcattaacccatctctgaactggtagaaaaacatctgaagagctagtctatcagcatctgacaggtgaattggatggttctcagaaccatttcacccagacagcctgtttctatcctgtttvvtaaattagtttgggttctctacatgcataacaaaccctgctccaatctgtcacataaaagtctgtgacttgaagtttagtcagcacgcccc

SEQ ID NO: 34799 - DNA, 143 bp, Homo sapiens
  misc_feature 2: r=a or g
  misc_feature 96: w=a or t
tragaggataaaatgagagaagatacataacagtcttttgcagtagactttggcacataataagagcttgtaagcagtggtggtaatgaaggtggwgcttgctaagaggagggaatgtcagtgttagaagcctgcgtggggag

SEQ ID NO: 34800 - DNA, 158 bp, Homo sapiens
ggcgtggtggtgggcacctgtaatcacagctactcagggagctgaggcagtagaatcgcttgaacctagggggcagaggttgcaatgagccgagattgccccattgcactccagcttgggcaacaagaacgaaactccgtctcgaaaaaaaaaaaaaa

SEQ ID NO: 34801 - DNA, 150 bp, Homo sapiens
ggcgtggtggtgggcacctgtaatcacagctactcagggagctgaggcagtagaatcgcttgaacctagggggcagaggttgcaatgagccgagattgccccattgcactccagcttgggcaacaagaacgaaactccgtctcgaaaaaa

SEQ ID NO: 34802 - DNA, 211 bp, Homo sapiens
  misc_feature 25: k=g or t
  misc_feature 33: d=a or g or t
  misc_feature 37: k=g or t
  misc_feature 77: k=g or t
  misc_feature 115: k=g or t
  misc_feature 196: k=g or t
aactcgggggtgacgctgcccgttkcccaggtdgaakaagcctcagcggaggcgatacggcctcctcgccaacactkaggaccccacggagatggcctcgctggacagcgacgakgagacggtctttgagtcccggaatctgagatgatgctgagccagggaggcggcccttccagcagccatgagggaaggacakgagatggggcccacc

SEQ ID NO: 34803 - DNA, 141 bp, Homo sapiens
  misc_feature 17: w=a or t
  misc_feature 99: w=a or t
  misc_feature 102: r=a or g
tcactgccactaccttwtccccacctttaaaagacctgaatgaagttttctgccaaactccgtgaagccacaagcaccttatgtcctcccttcagtgtwttrtgggcctgaatttcatcacactgcatttcagccatggat

SEQ ID NO: 34804 - DNA, 170 bp, Homo sapiens
acagttacaatttagccatgttatattacttaatcttcccaaacatcacgtgatataagcattattatccctctatacagttgaaagaacctaggttaaaggtcttaaataacttttcctagtttatacaaggaaagttaatagatctggaatttgaacatagggccctc

SEQ ID NO: 34805 - DNA, 50 bp, Homo sapiens
  misc_feature 14: s=g or c
  misc_feature 15: r=a or g
  misc_feature 23: r=a or g
  misc_feature 40: v=a or c or g
cttgaagctagaasrggaagttrgttaaaaatcacatcavaaagctacta

SEQ ID NO: 34806 - DNA, 216 bp, Homo sapiens
tacttttaaaataataaaataagcattattgaataaatattataattgtaagtttttttattttttattttttgagatggagtctcactctgtcactcaggctagagtgcagtggtgcgatctcagctcactgcaacctccgtctcccagattcaagagattcttctgcctcagcctcccaaggaactgggattacaggcgcccaccacacgccac

SEQ ID NO: 34807 - DNA, 74 bp, Homo sapiens
  misc_feature 8: d=a or g or t
  misc_feature 11: w=a or t
  misc_feature 28: y=c or t
cacgtcadgawgacgctcaccaactggyacaagcccggtgagacccggaagatgatcagcacgtggaccgccgt

SEQ ID NO: 34808 - DNA, 72 bp, Homo sapiens
tagagctgtagttcatcacatagtgatttcatggggcagatatttatagacagtccctgatttatgatggtt

SEQ ID NO: 34809 - DNA, 72 bp, Homo sapiens
ctcttgtttttaggatttagaaataccagcagtgcccatactccatagcatggtgcaaaaattcccaggcgt

SEQ ID NO: 34810 - DNA, 355 bp, Homo sapiens
  misc_feature 91: w=a or t
  misc_feature 92: r=a or g
  misc_feature 157: k=g or t
  misc_feature 238: b=c or g or t
  misc_feature 239: d=a or g or t
  misc_feature 240: d=a or g or t
  misc_feature 310: r=a or g
  misc_feature 327: m=a or c
acttagaaatttggaagccttcctttaagtaacactcttgttttctgtccaaatccaaaataaaagtgacagtaattagtagcataaatcwrcaagcagaatgtagcaaccagtacagagaggctggcctgacagtcctcaacgatacttttatttktatatatccactatgctcaagattagtttattaattctgtagcaggttaagggagtggaggcagctggtaatcgttgattbddttatatattttcattcaatagccatctgctgaatgtcttgtatgtgccaggtccgggttagggttggggrctcaatattgaatatgmcttgcacagcccctgttctcagcctagt

SEQ ID NO: 34811 - DNA, 119 bp, Homo sapiens
  misc_feature 95: k=g or t
gacacaaaggacatcaaactgccgagggtaaaaaccccggaagggcggacacctccacatcgccttttgccacctttccctttatttccggagakatttattgagtgtctactgtgtgc

SEQ ID NO: 34812 - DNA, 196 bp, Homo sapiens
  misc_feature 29: m=a or c
  misc_feature 84: m=a or c
caagaaatcttagaaccagcttgtgaggmaaaacattttttaatgtaataaaaatatgccattattctttgaaatgccaaatgmtataaatattttgcctaatacatatttattgtagatgaaatgcactcttctcgatgaggcctcgatttgaatcaatggggtgggccacaggaaatgtcagaggaaccagaac

SEQ ID NO: 34813 - DNA, 307 bp, Homo sapiens
  misc_feature 200: m=a or c
  misc_feature 205: m=a or c
  misc_feature 226: w=a or t
  misc_feature 227: m=a or c
agtcctttgggcctcagaattgcacaatggcacatccagagggggcctgtgtagttacctacgcaggtgggcatgttagaccataagcccactgttcttgggggaatgactgaaggctcatttgctactctggtcactaactgacaggacctgtcagcttctgactcttcaaaggagtcagacagtcggagaaggagacmattcmaggtcctgtgctccacagggwmaagaggagtttccagactatcagctgatgggactggggctgtctacccagggaagaaaagatttacaagacacaacgcct

SEQ ID NO: 34814 - DNA, 70 bp, Homo sapiens
taaaaaaaagataaattgattattagagatctttgttctgaaagtatgctctttcctaaaaaaaaaaaaa

SEQ ID NO: 34815 - DNA, 367 bp, Homo sapiens
  misc_feature 72: n=a, g, c or t
  misc_feature 241: k=g or t
  misc_feature 251: s=g or c
  misc_feature 261: s=g or c
  misc_feature 271: m=a or c
  misc_feature 355: y=c or t
cctttagttcatttattatttacctagaaagagaggtgtgtgtgtgtgtgtgtgtgtgtgtgctttgttttntttttccccgtcatgacctcacaaaaggctataggtcttagtcccacaaaagtaaaatagctctgccactgggatgtgtcttccttgttctgagctttttctcaaaaccctatcactggccctttagttttcagccgatgtacccaaaatatttccctcccaaagtgckggtattacasgcgtgagcascgtatccggmcaatcttttctatttcaaccttttctttttaactgtagcctgggaaatttttaacctgcaaaaagggtgggtccttgttgggtytcattttttaaa

SEQ ID NO: 34816 - DNA, 330 bp, Homo sapiens
caggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaa

SEQ ID NO: 34817 - DNA, 342 bp, Homo sapiens
  misc_feature 291: v=a or c or g
  misc_feature 292: b=c or g or t
  misc_feature 293: r=a or g
  misc_feature 302: k=g or t
  misc_feature 303: k=g or t
  misc_feature 313: k=g or t
  misc_feature 314: k=g or t
tttttttttctaacatgggtgacaatgagcaattgaatgcttagattgggagctgagagattatctttactttgttgagtaataaacacattaattaacaaaacaggaaaatcctgtcaaagaggaagtccttattaagatcatgctggaggccttttctattgcactggaaagattagctgagttcagtggtctttaagaaagtataatcatgaaaatagttacgtccagagctcagagagtttgaattatccttttgattggaagattctagcccagactattttatcvbrttctaaackkgccaaaaatkkcatattgtcaaactttccctccaccccc

SEQ ID NO: 34818 - DNA, 276 bp, Homo sapiens
ctcatttttctcttgccgccaccacgaaagaagtgccttttgcctcccgtcatgattctgaggcctccccagccatgtggaactgtttgaggcacagagctgtatatacaataacagtgaaattgatcccactactaattatgacaaaaatgatcttccacgtaaacaggtggtgaagctccttatggtcctgaccctacagttcctgtcccatgaccagggccagatcaccaaggagctgcagcagttcgtcgtcagtggcagccccatgcgagc

SEQ ID NO: 34819 - DNA, 222 bp, Homo sapiens
caacttaggcttgaatgttgaatgtttccagcttagggtttcctggaatgatgaatactagcatcttattcataatgatctgatcataacatctatgcaaattttagttattcctacttcaggatggtattcaaagtcttcatcgtatgtggccaatctttgatgagttggtaaaatctatataatataacctgttcatttttcaggtatgtgagcacatcc

SEQ ID NO: 34820 - DNA, 267 bp, Homo sapiens
agaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagcttt

SEQ ID NO: 34821 - DNA, 304 bp, Homo sapiens
  misc_feature 43: k=g or t
  misc_feature 78: k=g or t
  misc_feature 91: k=g or t
  misc_feature 101: k=g or t
  misc_feature 141: r=a or g
  misc_feature 169: k=g or t
  misc_feature 199: k=g or t
  misc_feature 224: k=g or t
tctaacattggtgaaggtaatgcagacttgaatatttgccackgcttgggtttgcagaaggctttaccttcatttgtktttgaattttgtkaaggaagttktagtgtatacttttctctagcatttttgtctctagcataraatttcaatatttatgtaaatgtatatkcttactgtttctttttgtaggacttttttkttctttttggatggagtctcactckgtcgcccaggctggagtgtggtggcgccatcttggctcattgtagcctccacctcctgagttcacatgcctcagccaccc

SEQ ID NO: 34822 - DNA, 150 bp, Homo sapiens
  misc_feature 80: h=a or c or t
  misc_feature 86: k=g or t
  misc_feature 103: m=a or c
  misc_feature 104: s=g or c
  misc_feature 122: w=a or t
  misc_feature 150: d=a or g or t
tctagtgaggatcctgaactcccagtgacatggcattcaggaactcattctccctgtaggtagaagcagcaaagaaagchcaccakgcagcgtgcaaagaggmsaagctggctatctcacgwgaagccaacagcaaggcagacccatctd

SEQ ID NO: 34823 - DNA, 86 bp, Homo sapiens
  misc_feature 37: k=g or t
ggtgtataaccttggactcacactgctgtctctgtakatgttctgtgagttagtaacaggagtatgggaaggcaaatacaacttct

SEQ ID NO: 34824 - DNA, 140 bp, Homo sapiens
  misc_feature 28: m=a or c
  misc_feature 29: d=a or g or t
  misc_feature 76: k=g or t
  misc_feature 78: m=a or c
  misc_feature 92: b=c or g or t
  misc_feature 104: k=g or t
  misc_feature 106: s=g or c
  misc_feature 107: k=g or t
acaatgttttcacgcctgtaaacctagmdcattgggaagccaaggtgggaggattgcttgaggccaggagttcaakgmtgcagtgagctatbattgcacactgkaskctagcctgggagacagagtgagacactgtctct

SEQ ID NO: 34825 - DNA, 178 bp, Homo sapiens
  misc_feature 11: m=a or c
  misc_feature 41: s=g or c
  misc_feature 109: s=g or c
  misc_feature 111: s=g or c
  misc_feature 115: r=a or g
  misc_feature 134: k=g or t
tgtgttagggmtaagcacacttcaaaagatgttttctagcsctaaattttatgacattgggtacttaaatttggagtacactagctattgagaacaatattttgggttsasgagrgatggttgaggccattatktagtgggagcattggcattttgaacactgtaaacaaaagaacac

SEQ ID NO: 34826 - DNA, 157 bp, Homo sapiens
ctctgtcactgcagccttcagccggggatggatgggagcggcctgcggctctgtgccgaagcacaggtcctgcctgtcctgtcttccaaggcgctaaatcacccctctgcctccgcccccgggggccgcagcctctatctcctgcatcaacgcgccc

SEQ ID NO: 34827 - DNA, 317 bp, Homo sapiens
  misc_feature 134: n=a, g, c or t
  misc_feature 135: h=a or c or t
  misc_feature 286: k=g or t
  misc_feature 287: v=a or c or g
  misc_feature 299: s=g or c
ctcatcagccttggagagtcaaggaagtgtatttagagaaaatgacttcttgaaatgggataatcagcaacattacagtcttgaatttcctccaggctctaggctatctacacactaaagaagaactgctgganhcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacckvgtctatcttctsatgaacccatatatgaga

SEQ ID NO: 34828 - DNA, 334 bp, Homo sapiens
  misc_feature 116: m=a or c
  misc_feature 295: m=a or c
  misc_feature 304: m=a or c
agctttttgacttgtaaaagtggtgaaggtttcaaagggacttgtcagtactgctctgtggaatggttggacttattttgcatccccttttcttgtaaagaatcgagattcaccgmgctgagacttttctctttaagacagctagccatccactttcttccactgctaattgaccagtggtcgagcatccataggatttctccccagtgtgaaaggctttattttaaaggcaagtgagactgcttcaaataaaacaacttcaagcttccaagaaacagttaagaggaggcagagmagagcagamacacttctttgctgacacttacactgttgc

SEQ ID NO: 34829 - DNA, 174 bp, Homo sapiens
  misc_feature 127: m=a or c
  misc_feature 128: m=a or c
catgacttgtcactgttaatgttgaccttgatcacctggccaaggtagtatcttccaagtttttgcacagtaatgttgccccccaactcccatcagccaccactcattcaatcctgtgttctttggmmtgaactcactatttgcagttatgttgcctcccatccccccggccca

SEQ ID NO: 34830 - DNA, 239 bp, Homo sapiens
  misc_feature 95: w=a or t
tgttgtttgagctgagactttaacgaatagagacaggtgaggttcctgcagcccatggcttcagcgtgaacaaccccagaaggaaaaagagtgcwgttgttaaaggtatctggcatcatggacccaaccatcaccaggagtttctcacttcatctctgtgtgataaattttgacatatgtatacatccatgaagccggcaccacaatcaagataatgaacatctcgcttaccccagtca

SEQ ID NO: 34831 - DNA, 204 bp, Homo sapiens
tgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggcccact

SEQ ID NO: 34832 - DNA, 182 bp, Homo sapiens
gataggctctgcctcccgaagaaaagggagccgcgcagcctacgggagtccggcggcagcagccggtaccggcaaccacgggcagctctcagggaatctccgtcgtgaggccagaggctccagtccccgcgagtccagatgcctgtccagcctccaagcaaagacacagaagagatgaaagc

SEQ ID NO: 34833 - DNA, 254 bp, Homo sapiens
aggagggtgctgttcgctgagctggagtccgggctccggtccccgccacggaccttgagagggtacccggggtcagacctggcagacagcccattttttcttatgataaagacggcatttggctcatgagcaaggtggcaagatcatcaagtgagtcagacatgcagctctgggaaacagaagaggatgacatgacagaagggagaagaaagaaatgaagcgagttttcagtattccaagcataagagccaggt

SEQ ID NO: 34834 - DNA, 233 bp, Homo sapiens
  misc_feature 9: s=g or c
  misc_feature 122: m=a or c
  misc_feature 155: s=g or c
  misc_feature 160: s=g or c
  misc_feature 161: h=a or c or t
  misc_feature 193: m=a or c
  misc_feature 231: y=c or t
acttccgcscagcagcagcaggtgtgtgatgcgctgctggcccaggctacaccccgacaagggacaccgggggccccgggagcagagagacctcagagcagcctcctcctgcctcctgtggmcggccggccccagctggtgatcccagccagtcscagcshtcagttgctgccacccacgacatagagatggmggcgcgtccagctggcaggtgtcgtccttcagcgagayac

SEQ ID NO: 34835 - DNA, 281 bp, Homo sapiens
  misc_feature 246: b=c or g or t
ctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgcbactacctccaccagggagagtccttctccacaggc

SEQ ID NO: 34836 - DNA, 382 bp, Homo sapiens
  misc_feature 336: s=g or c
gagaatgatttgaggggcattcggggggcaaaatcaacaggacctggggggagacgaagggatcaagaatgatgcccagattctgggtgagtggcagtgctgtggtgcacaagtagtgatgttatgtttccgggtgacctgctgtttagcaggagcccagcctgtggctaagaagtatagagaactgaaactagctccctagggatgggaaaaccaagtgggctgaggataagaacagggccccagggctgggtgcggtcgctcacgcctgtaatcttagcactttgggaggccgaggtgggcggatcgcttgaggtcaggagttcgaaaccagcstgatcaacacggtgaaacccgtctctaccaagaagtgcaagaatta

SEQ ID NO: 34837 - DNA, 168 bp, Homo sapiens
  misc_feature 31: w=a or t
  misc_feature 33: r=a or g
  misc_feature 72: r=a or g
  misc_feature 73: m=a or c
  misc_feature 112: b=c or g or t
gccgttggtgattacggaagaaccaggagtwtrgcgtgaccatggggaagcaaaagaaaacaaggaagtatrmgaccatgaagcgaatgcttagtctcagagatcagaggcbtaaagaaaaggatagattaaaacctaaaaagaaagaaaagaaggatcccagcgcat

SEQ ID NO: 34838 - DNA, 220 bp, Homo sapiens
tacgatcaggtgacttaatctttcagagtcccactgtcttcacatgtaagatgagaatactgattcatttgttccagagtcaaacccaggaatccatactcctttgaagcacttctcaggagattctgatggatggccagcattagcaaatgaaggcttgtccccaactccagtaactagtgtaaaagtagatctgatcttgtcctttgcagcatgtgga

SEQ ID NO: 34839 - DNA, 113 bp, Homo sapiens
gttccaaaaactttcaattaccttcaatgacattatcttattaagtaaagatgtctttcatgttgattcagtgttaaactttatgttaaaagatcatagagaatgtaagccct

SEQ ID NO: 34840 - DNA, 261 bp, Homo sapiens
  misc_feature 186: y=c or t
  misc_feature 187: s=g or c
  misc_feature 190: m=a or c
  misc_feature 233: y=c or t
  misc_feature 252: y=c or t
  misc_feature 253: s=g or c
ctcatgcccccttaatggagcactaactgcttgttttctggtgctggccaatccatatattgctgcatgctcaaataaattcattaagattttaatttgcctaattttatcttttaatagtctgtaaagctgtttccagtgtctgtaaattgctacagcaaattcttaaccatggggggatgtccysggmaccccttactttgtagttggccaagcataaaggtaggtagtcyaggcaccccattagcaacysgagtccgt

SEQ ID NO: 34841 - DNA, 67 bp, Homo sapiens
tgcaaactaggtcattcattcattttacaaatatagtttgagctttgaacaggtaacaggcactgat

SEQ ID NO: 34842 - DNA, 86 bp, Homo sapiens
  misc_feature 2: y=c or t
  misc_feature 3: k=g or t
  misc_feature 4: y=c or t
  misc_feature 15: y=c or t
  misc_feature 19: y=c or t
  misc_feature 22: w=a or t
  misc_feature 29: h=a or c or t
tykygaatgcagatyaacyagwgtgtathtgggaaaggttgtaataaatggagagggtgaagtggggatggttgatgagtacaaaa

SEQ ID NO: 34843 - DNA, 201 bp, Homo sapiens
  misc_feature 97: k=g or t
ctctctgggttcggcctccgcgcggtgcagcgcagtctcaggccgcgggacaagcccgacttaaatctctgcaatggctaacgaagcttatccttgkccgtgtgacattggccacagacttgagtatggagggctaggccgtgaagttcaagtcgagcacatcaaggcttatgtcaccaaatcccccgttgatgcaggcaa

SEQ ID NO: 34844 - DNA, 295 bp, Homo sapiens
  misc_feature 2: d=a or g or t
  misc_feature 72: h=a or c or t
  misc_feature 73: n=a, g, c or t
  misc_feature 85: k=g or t
  misc_feature 98: s=g or c
  misc_feature 188: m=a or c
  misc_feature 189: n=a, g, c or t
  misc_feature 200: v=a or c or g
adataaatatgtgcatgcatgtatgttaccatgtttggttttgtttataaaagtagaattgcatggaccaghntgtggtgaagtkctttagatatggsacgattaagttaaggtatctcaaagcccgatggcccagaggagaaaagccaggatctgggaatgtggcccctgcagtaatactggtgtamngtggtatgctvccaaacagaattacctaattcggatgggaatgggaaagccagatgtgagacattccaaagcagtggtccgaggggcatgctgagtcagtgaagga

SEQ ID NO: 34845 - DNA, 352 bp, Homo sapiens
  misc_feature 69: k=g or t
  misc_feature 87: k=g or t
  misc_feature 92: w=a or t
  misc_feature 97: r=a or g
  misc_feature 138: n=a, g, c or t
  misc_feature 139: n=a, g, c or t
  misc_feature 140: r=a or g
  misc_feature 224: w=a or t
  misc_feature 227: r=a or g
  misc_feature 233: r=a or g
  misc_feature 291: d=a or g or t
  misc_feature 332: v=a or c or g
caatgaaataagtgtatgtgcattgctgtctgtctctattgccaaaatcaaataaatggcttctcagckgctgtttacaacaaactkccctwagccraaacagaacctctaatttagggctaggaatagaagtctttnnrtcccagtccgtgggacagttttgtatgctgtatcttgtacacaggttgtaggttggtttattgccattttgttttatttctgcwatrtaaaarccaagagccagacaattagacaactatggaggaatgaaaggcaattcaaacatctgcdtgattcccgccccgccacccctaatttctgagagaataatvgttagagaacattgcatctc

SEQ ID NO: 34846 - DNA, 126 bp, Homo sapiens
ttgagtaacggcagaatatatggctgtagatccatttttaatggttcatttcctttatggtcatataactgcacagctgaagatgaaaggggaaaataaatgaaaattttacttttcgatgccaat

SEQ ID NO: 34847 - DNA, 56 bp, Homo sapiens
gttcctcctgcgaaacggtgcggtctggacacgtctccggggtgggtcgtccggcc

SEQ ID NO: 34848 - DNA, 57 bp, Homo sapiens
caggcactggacctgcatgccaaagggactggtcatctcctgaggacctgtaaatga

SEQ ID NO: 34849 - DNA, 51 bp, Homo sapiens
  misc_feature 31: k=g or t
ctccacagtgtttcataaggccatcctgttkcccccaactcccccattttt

SEQ ID NO: 34850 - DNA, 65 bp, Homo sapiens
atcacaggataatggaagtaaaccaaggaggtatacgtgtgggattgtgtccggaattggtgggt

SEQ ID NO: 34851 - DNA, 298 bp, Homo sapiens
  misc_feature 84: k=g or t
  misc_feature 237: k=g or t
catgcagactgctatttacatgagtaaacttgtctttgaatctgtaatcaggaactttagttccctggcgagcaattggagttktgctaatggtgaatctactctgcttgggccacttgtcatttagatgatgccataaaaatgtgcatatcacaaacaggatttctgtaacagttgacaattatgttaggatgactgttgattttgaatgggttttgggccaaaataagttactakctctgaaagcctccatttcaaagtggcctacagattctgatgagacttacatagggatgcc

SEQ ID NO: 34852 - DNA, 67 bp, Homo sapiens
  misc_feature 15: r=a or g
  misc_feature 38: k=g or t
cataaaatacaaaarcttagatgggcatggtggtgtgkgcctatagtcccactacttgtggggctaa

SEQ ID NO: 34853 - DNA, 81 bp, Homo sapiens
agtgtagaaaaccaaccaaaccaaacccaaaccaacaaaacccttcacctaaaacccgaagctacccagacctcagaattt

SEQ ID NO: 34854 - DNA, 79 bp, Homo sapiens
atattatgtcagactagcaagccctgcctcagcttttccccaacatggaatgctattctaaaagcacccatgtattctt

SEQ ID NO: 34855 - DNA, 456 bp, Homo sapiens
  misc_feature 229: y=c or t
  misc_feature 455: w=a or t
ctctcttgtttccatagtttcctgactggaagtatctttttgatcaagatttcctttgaagtctattttaacaggattttcatgtcagtattaaggtataatttcttagtgggagaatgggggctgtatctcctaaatgtctaattaaatttaaatttagtatatctgactaagaagggtgaggatggtggcttgaatgccctcttcccttttaaacctttcttcactyaagggacatgaaagagtgaggcttatccatccgaccaacactactctttccttctttccagtggatgtgggattggagaagaataagataaataagttacagtaaatttgttgctaacaatctgtgtaaattattgatttctttgtaagtgtatgaacactttcattaggttaaattgttgatattttaaagtttttgacctcagtggcagtttcatatggtttgwc

SEQ ID NO: 34856 - DNA, 417 bp, Homo sapiens
  misc_feature 221: n=a, g, c or t
  misc_feature 328: s=g or c
  misc_feature 348: r=a or g
  misc_feature 375: r=a or g
ctctttttcatgcctgtctaagatcaggcctttcaaaatatgtactgcttcattctggtggcagtattaactgttaggtgaactttgggagggagtggttgactggagcagtcaaaaaggatcgcatctctttttaggcatcactgagtgttattcacgcaatcaacatggcatctttttgtcggtagctttggtttttgactcatgccaatgcacagcangttctttgctgatgaatagatttctctgcctcttatcaggagttgtctgctgtggggtagggaggatgttgagttacacacctcaaaatgattgctagtgcatacasatggaatctaacaaaagtgrcgtgttttattctgggaaaggtcgagrtaaattggtgctagagttgtcttgtttgatcattaattggct

SEQ ID NO: 34857 - DNA, 353 bp, Homo sapiens
  misc_feature 47: m=a or c
  misc_feature 48: m=a or c
  misc_feature 83: k=g or t
  misc_feature 88: k=g or t
  misc_feature 201: k=g or t
  misc_feature 211: k=g or t
aatgaatccatcccattgcctccccaactctgcccacacctgctgcmmcagctaatgccttgattttcctacctcagtctccktttckattaatccctcttttgcgtggctgcctgagtccactttctcaaacacaaacctcactatgcaactttggaatctctgtaggctcacctttgccatttcttaatattgcattckccaaattgckaatctctatccagtctcttgaactagacttggcacatggagattccgctcagaaagtgctcttcacacttctacctgcttgactaaccccagattatctttcaagactttaatctgatcttgtgtcttagagaagccccatt

SEQ ID NO: 34858 - DNA, 337 bp, Homo sapiens
taggaatacagcttacaaggatgtgaaggacctcttcaaggagaactacatacaaaccactgctcaaggaaataagagaggacacaaacaaatggaaaaacattccatgttcatggatatgaagaatcaatattgtgaaaatggccatactgctgaaagtaatttatagattcaatggtatctccatcaagctacctttgactttcttcacagaattagaaaaaagtactttaaatttcatatggaaccaaaaaagagcctgtatagccaagaaaatcctaagcaaaaagaacaaagctggaggcatcatgctacctgacttcaaactatactacaa

SEQ ID NO: 34859 - DNA, 218 bp, Homo sapiens
  misc_feature 194: h=a or c or t
ccagaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataahatatttctttttttgagggcagat

SEQ ID NO: 34860 - DNA, 388 bp, Homo sapiens
  misc_feature 47: w=a or t
  misc_feature 278: n=a, g, c or t
ggatcttccacacgagtgggattctggccttcagagaccaggagggwgtgtctgggccgcagtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgnggctttagctgttagaaaggaacccccgtgacttgacacagctttcacagctggctgctaggaccggcgggctgggtgttcacgtgtgtctgtgtcatggatgcaatgca

SEQ ID NO: 34861 - DNA, 328 bp, Homo sapiens
  misc_feature 31: k=g or t
  misc_feature 39: r=a or g
  misc_feature 89: k=g or t
  misc_feature 92: w=a or t
  misc_feature 94: b=c or g or t
  misc_feature 98: s=g or c
  misc_feature 100: k=g or t
  misc_feature 104: k=g or t
  misc_feature 109: r=a or g
  misc_feature 242: r=a or g
  misc_feature 243: r=a or g
  misc_feature 271: k=g or t
  misc_feature 310: r=a or g
ctggttaaactctgttaaaagtgggccttckatcttggrtggtttcactgccatcagccatgctgatatattagaaatggcatccctakcgwabggastkgaakgcttraaattatacataaaatgctttatttagaaaacctacatgatacagtggtgtcagccttgccatgtatcagtttcacttgaaatttgagaccaattaaatttcaactgtttagggtggagaaagaggtactggrraacatgcagatgaggatatcttttatgkgcaacagtatcctttgcatgggaggagagttactcttgraaggcaggcagcttaagt

SEQ ID NO: 34862 - DNA, 66 bp, Homo sapiens
ttggatatactgtatctgaagaaaactacatgtgtcggaggtttctaaagtaaaaatcttgtaaga

SEQ ID NO: 34863 - DNA, 434 bp, Homo sapiens
  misc_feature 365: k=g or t
gagaagtcatccatctcatgaagatggccttgattaacacttgtgcataaaactgggttatagtatgtttgatcagaacaaagaggatgtaggttaagtaatcactgggattgtctgtaaatgcagatcccaaataggcattcagagctgttgtaatggcatcattattggaagaatgattcatttgaattcgtatattcaattttttgttttaaaatctcatcatttgacagtcttatcctcaaaagtgatttttataaagcttttttttttagaaaaatgtataaagttcccttcatttcttagttgtcagatatattagttaggaagcaggtaagactgctctaataaagggatcccaaaakatagtggctcaaataaggcagagattatttctcttttgagtctaaggaggcagactagggctgacatgt

SEQ ID NO: 34864 - DNA, 228 bp, Homo sapiens
ttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctccctaa

SEQ ID NO: 34865 - DNA, 303 bp, Homo sapiens
  misc_feature 298: k=g or t
ccttctgagcccgatcccgtgttgtcctccagggggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttcccctttgggttcatttgctgttttgccttgaggaagcgacgatgccccaactgtggagccaccttcgcttaaagggaacaccaggcccggctttcctatkcgcca

SEQ ID NO: 34866 - DNA, 342 bp, Homo sapiens
  misc_feature 198: n=a, g, c or t
  misc_feature 200: d=a or g or t
  misc_feature 334: b=c or g or t
acctaatattgtatcattgtgctgtctgcaaaacaacttgaatctattttgtttgcatcttttgttacatgtaacgcagctgtactttatgttctttgcaactgtttccattatgagaacgctgtgctatttacaaggttacatttttcttggccaggcgaggtggtcatgcctgtaatcccagcactttgggaggcnadggtgggcggatcacttgaggtaaagagttgagaccagcctggctagcatggcgaaacccagtctctactaaaaatacaaaaattagccgggtgaaattagccgggcgtggtggtgtgtgcttgtaatcccagcbactcgggc

SEQ ID NO: 34867 - DNA, 297 bp, Homo sapiens
  misc_feature 56: h=a or c or t
  misc_feature 77: k=g or t
  misc_feature 91: r=a or g
  misc_feature 92: r=a or g
  misc_feature 96: r=a or g
  misc_feature 235: v=a or c or g
catttgaacttgttttattaagtgcttacagacacacagccctgtgccacctgcahactgcctgaggatgcatagtkccatatcactgagrrggaratggctctgaaagaaaagggatcgcccaaagccctgcagttgtctggacttttaatttttaaaatttttaaattttaaattaaaaaatggtattttttgagacaaggtctcactctgctactcaggctggggtgcagtvgtgcaatcatggctcactgcagcctccagctcctgggctcaagtgatcctcctgcctcagcc

SEQ ID NO: 34868 - DNA, 67 bp, Homo sapiens
ccccagaaactaatgttgaaatacctggaacaaataaagaatatggccattactcctctccaagtct

SEQ ID NO: 34869 - DNA, 238 bp, Homo sapiens
ttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctaa

SEQ ID NO: 34870 - DNA, 71 bp, Homo sapiens
  misc_feature 34: k=g or t
acataacagtgccattagctcaaaacttgaaatkaaatgccaaaacaagaacggctttacagtttccttgt

SEQ ID NO: 34871 - DNA, 331 bp, Homo sapiens
  misc_feature 128: k=g or t
  misc_feature 129: k=g or t
  misc_feature 217: s=g or c
agttccttcccttgaagcccacagcccatcgaggaagacaggctcgtggaggagttcatgctcttggccaacatggcagtggcccacaagatccaccgcgccttccccgagcaggccctgctgcgcckkcaccccccgccccaaacaaggatgctcagtgacctggtggaattctgcgaccagatggggctgcccgtggacttcagctccgcaggascctcaataaaagcctgacccaaacatttggagatgacaagtactcactggcccgcaaggaggtgctcaccaacatgtgctcccggcccatgcagatggcactgtacttctgctc

SEQ ID NO: 34872 - DNA, 386 bp, Homo sapiens
  misc_feature 36: n=a, g, c or t
  misc_feature 186: d=a or g or t
tacttttttttgagagttttgctctgtcacccaggntggagtggggtggtacaatctcggctcactgcaacctccacctcccaggttcaagagattctcctgcctcagtctcccgagtagctgggattgcagatgtgcatcaccatgcctggctaatttttgtattttttagtagagatggggttdcaccatgttggtcaggctggtctcgaactcctgacctcaagtgacccgcccttgtcggcctcccgaggtgctgggattacaggcatgagccattgtgcccagcctatatagtgtgaagcttttaggaaaatcagagcagggtagacagctgttaaaaacaatgtttaaatggaataatgttgaatgtttacaggctgtaa

SEQ ID NO: 34873 - DNA, 243 bp, Homo sapiens
gaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacagactccctgcgacaaggactgtgtactgcatgaatgaggctgagatagttgatgttgctctgggaatcctgattgagagccgc

SEQ ID NO: 34874 - DNA, 68 bp, Homo sapiens
gactatgggtttgtagtatagattgaagtcaggtaatgtaatgcctccagatttgttctttctgctta

SEQ ID NO: 34875 - DNA, 181 bp, Homo sapiens
cttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatca

SEQ ID NO: 34876 - DNA, 202 bp, Homo sapiens
ttgggaccagaagtatgccatagaaatttaactcttgtttatatcaattaacctacagtaaaattggttttagtatatgttgtttcacttaaagttgcagtttccaagaacctatggaagatgttaagtgaggacttactgtagtcataattttaatttctcttattttgataattgcatattttcttatgtttaagggcca

SEQ ID NO: 34877 - DNA, 426 bp, Homo sapiens
  misc_feature 170: k=g or t
  misc_feature 171: k=g or t
  misc_feature 403: s=g or c
ttgaaaatgatatgaatacatccgtaaatacaaacatttgaaaacattttcacatttttattctaaaacagaaatgccattatattggctgtactaatgtgcccttaaaaaaaaagtaagattgtgaacatatgctatgtaggttagaatgtgattgtgatcaacataakkcatttgaagagtataattataacaatttaaataattttataaaaggccgggcatggtggctgactcctgtaatcctagcactttgggaggccgagatggatagatcacttgaggtcgggagtttcagaccagcctggccaacatggcaaaaccctgtttctactaaaaatacaaaaattagctgggcatggtaacgcttgcttgtaatcccagctacttgggatgctgaggsataagaattgcttgatcctggga

SEQ ID NO: 34878 - DNA, 370 bp, Homo sapiens
  misc_feature 12: r=a or g
  misc_feature 289: b=c or g or t
gtgttccaggartgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagbggtccgggaggccctgccgtcctgtctcctgcaccattgggtggagtctggtgatcacattattgattatgtttcttaaac

SEQ ID NO: 34879 - DNA, 372 bp, Homo sapiens
  misc_feature 274: b=c or g or t
  misc_feature 282: s=g or c
  misc_feature 314: s=g or c
  misc_feature 330: s=g or c
  misc_feature 352: y=c or t
agtcccagctctgccaggaaaggggagacttcaccgtggcactgggaattggattctaaactttaggatcggcaatggaaggacctggaataagacaccttcttgacccccctgaagggctctgagcagctgggcttgcctttctctttgctcccccagtcctccccttacttctcggtctcccactccccatcactcctttccctgcctcctcctgcctgtctccatcttcctccctctctttcttctctcgccccattaatccctgcttgtbactatcasctccttcctccagtctttcccccttcgctgcsccttctttcctctgasatttccttctcctcttactgcyactgtctcccacctttctcc

SEQ ID NO: 34880 - DNA, 135 bp, Homo sapiens
  misc_feature 3: y=c or t
  misc_feature 61: s=g or c
  misc_feature 86: b=c or g or t
  misc_feature 92: s=g or c
  misc_feature 117: n=a, g, c or t
  misc_feature 118: y=c or t
ggygcgatttcggctcactgcagcctccacctcccgggttcaaatgattctcctgcgtcasctcccaagtagctgggattataggbataggscaccatgctggctaattttttaatnytcgtagagacggggcat

SEQ ID NO: 34881 - DNA, 290 bp, Homo sapiens
  misc_feature 90: y=c or t
  misc_feature 91: k=g or t
ccctggtaaatcgcacatacacagagttttgcctttcaggacatatggccttataagattttgactactagtgaccaaaatgttgatgtykttcaaaaatgacacagaatgttaagatggaatagttttattcagcaaacaaaaaacttgctaattcagagtatcctctagtccacgtaatgtggtttagactacatttgcaaaattagggccttgacgctgaacaaaataaaatccagaggaagaactacagtatccaatcaaaaaggaagtactagcaaatgaacccc

SEQ ID NO: 34882 - DNA, 144 bp, Homo sapiens
  misc_feature 91: s=g or c
ctttttcctttttaatgtgtttatgtctatagattttctcctcagcactgcttttgctatatcctgtaagttttgagtctcgctctgttgsacaggctggagtgcaatggtgtgatcttggctcactgtagcccctgcctccct

SEQ ID NO: 34883 - DNA, 313 bp, Homo sapiens
  misc_feature 267: s=g or c
  misc_feature 293: w=a or t
cagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggaatggcaggctgaagtcagaggggctgtttcattctcagccccstcagcagcactgggggaaagaaagcwtgtcacaacaggttctttct

SEQ ID NO: 34884 - DNA, 206 bp, Homo sapiens
ggggttggcctaggcgaagatccggactctgggtgttttgctaccgtgaccgtttagaaacagagtctcgctctgtcgcccaggctggagtgcagtgtggcccgatctcagctcactgcaacccccacctcccgggctcaagagatccacccacctcagcttcccaagtagctgggactacacgcgcccgctaccacaaccggcat

SEQ ID NO: 34885 - DNA, 63 bp, Homo sapiens
aattttcctgttgcttttgcttgcttctccatttaatagttactgaactttatgcatgttgat

SEQ ID NO: 34886 - DNA, 279 bp, Homo sapiens
  misc_feature 26: k=g or t
  misc_feature 66: k=g or t
  misc_feature 67: k=g or t
  misc_feature 73: k=g or t
  misc_feature 75: k=g or t
  misc_feature 76: r=a or g
  misc_feature 78: r=a or g
  misc_feature 98: d=a or g or t
  misc_feature 221: r=a or g
  misc_feature 233: k=g or t
  misc_feature 265: k=g or t
cagtatcacgtatttaaacatttttktttcttttagccatgtagaaactctaaattaagccaatakkctcatktkrgratgaggatgttctcagctgdgaaacgttttaaattctctttattcataatgttctttgaagggtttaaaacaagatgttgataaatctaagctgatgagtttgctcaaaacaggaagttgaaattgttgagacaggaatggaraatataattaaktgatacctatgaggatttggaggcttggcatkttaatttgcagata

SEQ ID NO: 34887 - DNA, 202 bp, Homo sapiens
  misc_feature 21: s=g or c
  misc_feature 29: w=a or t
  misc_feature 32: b=c or g or t
  misc_feature 48: k=g or t
  misc_feature 50: k=g or t
  misc_feature 94: k=g or t
  misc_feature 95: k=g or t
  misc_feature 99: k=g or t
  misc_feature 144: k=g or t
  misc_feature 154: y=c or t
  misc_feature 170: s=g or c
caggagaaagaagctatagasaggttgawggbcctgggcttcccagakakcctggtcatccaggcctatttcgcgtgtgaaaaaaatgagaackkggckgccaacttcctcctgagtcagaactttgatgacgagtgatgccakgaagccaggycaccgaagcccccacsctacccttattccatgaaagttttataaaaga

SEQ ID NO: 34888 - DNA, 343 bp, Homo sapiens
  misc_feature 90: r=a or g
  misc_feature 95: k=g or t
  misc_feature 110: k=g or t
  misc_feature 236: v=a or c or g
  misc_feature 267: n=a, g, c or t
  misc_feature 271: r=a or g
  misc_feature 309: r=a or g
  misc_feature 324: r=a or g
  misc_feature 336: r=a or g
  misc_feature 337: k=g or t
gactttattttgtgaaaaatgggcagtcattgaaaaattttaacatttaaagatattttggatcgtaattttttgttaaaattaatatgrtggtkgtgttagtcagtttkcatgctgctgacaaagacatacccaagactgggcaatttgtaaaggaaagaggtttaatggactcatagttccatgtggctagagaggccttacaatcatggcagaaggtgaaaggcacatcttavgtggcagcaggcagagagaatgagagccaantgaraggggaaacctcttacaaaatcatcagatcttgtgagrcgtattcactaccargagaacagtatrkgggaag

SEQ ID NO: 34889 - DNA, 334 bp, Homo sapiens
  misc_feature 301: m=a or c
  misc_feature 302: r=a or g
  misc_feature 308: m=a or c
ccgcattttctagagctatctgcactctcatgttaattgcagcattattcacaatagccaagacatggaaacaatctaagtggtatctatatatagatgaacagataaagacattgtgacaggtctgtatatgatattgtgatatatgtcatatgtatgtatgatatcacaatattattcagccttaaaaaaggagatggggggaatgtataaacctagagtacattttgctaagtgaaataaaccagacacagaaacaaataaaggcatgatattacttatatgtggaatctcaaaagamraataamgtcaaatgcatagaaacagtgtaaaa

SEQ ID NO: 34890 - DNA, 416 bp, Homo sapiens
  misc_feature 356: s=g or c
  misc_feature 394: d=a or g or t
  misc_feature 395: y=c or t
catgcctagatccatcacttgaagccaagtcatctctcttcatttaaccttgctacataggccttagcgtcctgaatcgcttcgcacttgcctgtgaatcttcacaggttttccaaatcctgcttaggttgtgtgcccagactgaatgcagtatgtttaaggctcaggactcttgctgggcagtgtgaggggcacattcccactggcagaagatcttttccaggtatcttagtctgtttgtgctgctataacaaaatactatagatcaggtggcttagaaacaacagaggtttatttttttcacagctttggaagctggaagtccaaggtcaggacactggcagtttctatgtctsgtgaggatctgcttcctggttcattggtgatgctttcdyactgtgtcctcacacaatggt

SEQ ID NO: 34891 - DNA, 88 bp, Homo sapiens
  misc_feature 2: b=c or g or t
  misc_feature 29: k=g or t
  misc_feature 30: m=a or c
  misc_feature 45: m=a or c
tbtgttcgtgcgtcgggacggcgcgtcckmccgcccttaaagggmccgcacctcggaaaactcgcagcccagcacggcgtcgggtagc

SEQ ID NO: 34892 - DNA, 234 bp, Homo sapiens
  misc_feature 233: r=a or g
  misc_feature 234: r=a or g
cttttttttctctgcagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgarr

SEQ ID NO: 34893 - DNA, 274 bp, Homo sapiens
ttttgcaagtggggtcttccatgaaattaccaggttcattggtatatgtgcagactttttctataggtcaattgcttgctgtgggagtttggtgtacagactttcatcacccaggattattttcaggattgaaatgaaaaagccaaaattgacaaatgggatcgaattaaactaaagagcttctgcatagcaaaagaaaccaccatcagagtgaacaggcaacctacagaatgggagaaaatttttgcaatctactcatctgacaaagggcgaa

SEQ ID NO: 34894 - DNA, 374 bp, Homo sapiens
tcttgttcctgttcttaccatctcttaccaatgggtatcacgttagctgtgggttttcatatatggcctttattatgtggaggaagtttccttctattcctagtttagtgtttttctcatgaagggtatggaattttgtcaaatatattttctgcattaattgagatgatcatgtattttcccttcattctgttaatgtggtgtattacattgattcattttaaaaaattagagatttataatatttttattttttgagcctggtctcaaattcctaacttcaagtgatcctcctgttttggcctcccaggtgctgggattacagggctgagccaccactgtgcccggccttgatccatttttgtttagtttaa

SEQ ID NO: 34895 - DNA, 190 bp, Homo sapiens
atccatccacccaccaatttaccctttcatccacccatctacccattcatttatccatccagccacccatccactcatctatccatccatccactcatctacccatgcatccatctgtccattcatccattcacaaattcacccatccatccattaatctatccatccacccatgcatccatgcatccat

SEQ ID NO: 34896 - DNA, 163 bp, Homo sapiens
taacattaggtgcaattataagtcctccaattaaaccctaaggatcctatttgtttttataggcagcagtaacacaatgggcagaccccttcgctctgttattcccctgtctggaattactatcagggtaacaagttggcaattaaatccaaaaccacagtta

SEQ ID NO: 34897 - DNA, 408 bp, Homo sapiens
  misc_feature 306: w=a or t
  misc_feature 307: k=g or t
tagagagaaattgtgtatcttttcagaaaatagttttagactagagattaataatgaacacttgaaagttgtcatgggaactccaaggctgtctttagtacattctggtgaatgaatgatttctctcatgtttttccctcatgccccagtctgctgcccatttctcttggagggagtcatgttctttttcacctgaccattggttcttaccctttgcctgccctttaaataaatttctttccttttttctttatctcccttaacagcctttttctaatagtggaagttacagatttttctctgcawkacaagaaaaattgccagaatacatctctctaagtcactgctttggtcagcatatcctagccgtcttcagaaatctggagtgactgctcttgtcaaccatgt

SEQ ID NO: 34898 - DNA, 166 bp, Homo sapiens
gccaattattaaagtatttttttgttttcttactggtacagttcattataaaaagcaaagcttgctattccctatctaggagccatcagttttcttgtgctgttagggaaggatgaaaaaggagggatggctgggcacggtggcgcaggcctgtagtcccagcgaa

SEQ ID NO: 34899 - DNA, 232 bp, Homo sapiens
tgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacta

SEQ ID NO: 34900 - DNA, 282 bp, Homo sapiens
  misc_feature 218: k=g or t
aatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgkgacatggaaaagaaggcagcctaggccctggggagcccagtccactgagcaagcaagggactga

SEQ ID NO: 34901 - DNA, 223 bp, Homo sapiens
ctcattttagatatcttggactgagcagtggggcctttactgtatttttcctgataaatacacatactggccactccttatctctttttcttgaaaagtgaactttttaaagcagtcaagtcaacatcaggctactgaagttgaggctttagggtaactttcctatattgagcccatgggttacaaggatttgcaatatattgttccatttacagccgaatgc

SEQ ID NO: 34902 - DNA, 335 bp, Homo sapiens
  misc_feature 81: r=a or g
  misc_feature 85: r=a or g
  misc_feature 87: r=a or g
  misc_feature 302: r=a or g
ttaaaatgtggagtggatcatgccatttaattagaaaacacataggtgctgaatagatctgaaaccaattcaagtggaagratgrarattattcccattgagtacacattcaaaaagcaaaagtgactttctcatttctgttttgaaattataaatttttttttactactttaatttatggaactattgtaagaaaaccttcatcccattgatacctaaagaaaagtattaggcaataagaatcagcaacttacagatggcaaaataggtggcagtatattgctttttaaagatatttggaratatgatgctattcagtgttgtataaatattgc

SEQ ID NO: 34903 - DNA, 211 bp, Homo sapiens
cactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcccccact

SEQ ID NO: 34904 - DNA, 263 bp, Homo sapiens
  misc_feature 2: k=g or t
  misc_feature 34: k=g or t
  misc_feature 57: k=g or t
  misc_feature 67: k=g or t
  misc_feature 73: k=g or t
  misc_feature 104: k=g or t
  misc_feature 186: m=a or c
  misc_feature 210: k=g or t
akatttgtcggtagtctgggagcctgtgaaactktgtcctcaaacatcgcaggctgkggctctcgtkaacctkctggaagcgggggattccaagtacctagackctgagtttacatggcctcaagggttttcaagaaatgatttcaggacaagctctgctggagtgcaaaggcgcgatctcggctmactgcaacctccgcctcccaggtkcaagcgattctcctgcctcagcctccagaatagctaggattacaggcgcatgc

SEQ ID NO: 34905 - DNA, 217 bp, Homo sapiens
  misc_feature 124: n=a, g, c or t
  misc_feature 125: h=a or c or t
  misc_feature 169: w=a or t
  misc_feature 170: v=a or c or g
ctccggggggcaatgagggggcagtggaaggggcactgctcctcgggcattacttagagaaacgagaccgtcccgccctctcgccggccctccctctctcccgcccgggcccgcgcaattctcnhccagagggacagtcggcccaatatgtcaagacctctgatcactwvatcccctgcatctccactgaacaaccaaggcatccctactccagcac

SEQ ID NO: 34906 - DNA, 347 bp, Homo sapiens
  misc_feature 70: w=a or t
  misc_feature 347: w=a or t
aacttcgtttttattggtcataacagtccaattatattcttggccaattttgtccaacggacaagaaaawagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaagtattttttcttw

SEQ ID NO: 34907 - DNA, 185 bp, Homo sapiens
cacacactaaattcgcattttgctacagtgatttcctctctcagaatgcaaacttttactataccatgagccccttaaagacagaatcccctatagcatctacttcatgtcttccacatagtaattgctcaatatttattggattggaaaaaagattagttttatcgtaatatgaatagagccct

SEQ ID NO: 34908 - DNA, 244 bp, Homo sapiens
atatgtgggtggaacggggaagctggagcagatttttggaggaaagcaaaactggggactttcaggactaggggcctgggtctcagaagaatgggaaaggacgagaaaggagtctaaataagaaccctgctattagcattgtttggttttcttttcaggtgctgacctgaacctggttcatccctttctgaccaaaactgttcactcaccgtggaagggactaagcatccatatggagacgccc

SEQ ID NO: 34909 - DNA, 131 bp, Homo sapiens
ttacacaaataaagggggaactaggtaggttctctgatgaccctaataaacatagagaggttttccaaaatttgacccaaatgtttcatgttacatggagagatgctatgctacatttaagccaaaaccca

SEQ ID NO: 34910 - DNA, 333 bp, Homo sapiens
gctttagctatgctgcctttttattcaggtcttctctgatcactgtagagaaagtgggatgctcccattcctgcctgccctctctctattaatttacctaatttcatcattcttcatagtacttcttaacacctgaagctgttgtatattgatttgttagcttactcattgtatgtctgttccagtaaaatattagcttcaagagcacaagaacttagtctatcttgctcactccctcatctatgggcacagaactgtacttggcatgttgaaagttctctctgggccaggcgtggtggctcaccactgtaataccagcactttgggaggctg

SEQ ID NO: 34911 - DNA, 158 bp, Homo sapiens
  misc_feature 111: r=a or g
caataggacaaatagtatagcgttatatagggtaacatagaataagaaacagtgtaacttatagtatagtgtacaataggacaaatagagtgttctatagggtagcatagratagatgaaacagtgtaacattatatatatagtatacaataggacaa

SEQ ID NO: 34912 - DNA, 250 bp, Homo sapiens
tgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggtaggagatggtgagtttataaaagactgtctattgagtgcagcggaaatcatgtgtcctgaacag

SEQ ID NO: 34913 - DNA, 313 bp, Homo sapiens
  misc_feature 226: n=a, g, c or t
  misc_feature 227: y=c or t
  misc_feature 271: w=a or t
  misc_feature 272: n=a, g, c or t
  misc_feature 273: n=a, g, c or t
tgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatcnytaaaacagacttcatcacgcacacacaataagtctttctctccwnnaaccggaagtaaatctatatctgttagaaataatgtagcc

SEQ ID NO: 34914 - DNA, 360 bp, Homo sapiens
  misc_feature 314: k=g or t
catttttaggcctgaaaccacggttggcatcaaaggcagaaccttagataagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggkgtactttcttaatgactgaaagataagtgggtagcaccgtcagaga

SEQ ID NO: 34915 - DNA, 200 bp, Homo sapiens
ttaatcactcatttaagttatctgtttgtgaaagttcacaattaatatattatccctaatggtgtaataccttcccaccatataaagtttataaggattgtgtgactttagtcattcctatacatacaacctagtttaaccgattttacctttaaaaaaaatctttgtgacctaatcacttaaactaatcaaaatagctt

SEQ ID NO: 34916 - DNA, 247 bp, Homo sapiens
  misc_feature 245: s=g or c
ctatttgtctattagttgtataaataacagaaagaggggtgttaaaatctccaattatggtcatggatttgatgaagaatattccacccactctttttttttctttgagacagagttttgctcttgtcgcccaggctggagtatagtggcacgatcttagctcactgcaacctccggctccctagttcaagagattttcccacttcatcctcttgggtaggtgagctgtgcaccaccacgcccasct

SEQ ID NO: 34917 - DNA, 313 bp, Homo sapiens
atttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggagcg

SEQ ID NO: 34918 - DNA, 378 bp, Homo sapiens
ttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagcgtaagagcaagtataggatatggagaggcccctggcttcatgagaacaaaggcaggcccaggttataattacagctttctcctgccccttctttactttctctaccacagttttctccactgtttgttttcctcttgccacaatttgctaacatttaaaaaattttcctgtaccct

SEQ ID NO: 34919 - DNA, 143 bp, Homo sapiens
cttcagaatgcaactttctcacagaacacaaggctctcaaggggcttcagcaccccaagcactgcagcgtttctcccaggaggctgggcgagtccgtagcggaagtcggagcggcagagcagtgattgggtgcggccggccat

SEQ ID NO: 34920 - DNA, 140 bp, Homo sapiens
aatataactttttaaaatgaaaggagtcaccttttacatgactcaggtgaaaaaacagtataaacattaatttactttgtgttcaaaagaaaattccaactgctgttggggaaggacacagaaaagaaaaataaccaccc

SEQ ID NO: 34921 - DNA, 464 bp, Homo sapiens
  misc_feature 304: y=c or t
  misc_feature 392: m=a or c
  misc_feature 446: y=c or t
cagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggytgacattaaggaccagctggctatggtcctcaggctacggtcctcagtattctagtatttgagtagtggaggtaaatccaaaggcgamtggttatattttacttctaaatgtgtgctgaagtgtctcttgttcaaaaattcytgatatttagagcttcaa

SEQ ID NO: 34922 - DNA, 172 bp, Homo sapiens
gcggcgggagctggacgcgggaggaggcggcggcggcgctggaacagtgaaccatggagctgtatttcggtgaatatcaacatgtgcagcaggaatatggggtccatctgagactcgcaagtgatgatacccaaaaatcaaggagttcccagaactccaaggcaggctccta

SEQ ID NO: 34923 - DNA, 189 bp, Homo sapiens
  misc_feature 47: s=g or c
  misc_feature 49: s=g or c
  misc_feature 90: k=g or t
ggggccgcgtagggcccactggccagggagggcgccgcgcggaggcsgsggcgtgtctcctgtcaaaagccatgctcggcaggtctgggkaccgggcgctgcccctgggtgattttgaccgcttccagcagtcgagcttcggctttctgggctcgcagaagggctgcttgtccccggagcggggcggtt

SEQ ID NO: 34924 - DNA, 165 bp, Homo sapiens
  misc_feature 124: h=a or c or t
acctgtagggtctccatcaggaagccctaggtgccggcaagaagggtagtggaaagacgtgacctgccctcaagcagctcagcctcacggggaaaagaaatgttgcacacactggaaggttgchtttattatatccatttctgtattcgtaccagcacctcagcg

SEQ ID NO: 34925 - DNA, 63 bp, Homo sapiens
gctgagattgcgtcactgaactccggcctgggtgacagaaggaggctctgccttaaaaaaaaa

SEQ ID NO: 34926 - DNA, 187 bp, Homo sapiens
  misc_feature 45: r=a or g
  misc_feature 49: r=a or g
  misc_feature 110: s=g or c
  misc_feature 139: m=a or c
gatactaggacactatattgtacacaccgcaggtggatttggtaraaargcagaaattaacgtgcaaggagagagaaaatgggcagaagtctgtccttgagacgggagasagaaggggtccaacacaggaatgggtgcmgggctgcagggacactgtctgtcctcacaggggaggagcagagagagt

SEQ ID NO: 34927 - DNA, 280 bp, Homo sapiens
acttcccgcggcgggggcacggcagacgttgggggaagcgccacgccgactgagtcagctgctggggggcatgcccagtgccttggttccggattcttccataaccggctgccagtaccgcctctctgacgccgggagttgctccctaagatctgctgccgcctttcgctggactttccccctgggtggagcggccgagggggtttcgaagcctgcgtatccctgactcttcacccagcgcctccgtgtccctctacgggctctaagcgttcccccgcat

SEQ ID NO: 34928 - DNA, 176 bp, Homo sapiens
  misc_feature 2: b=c or g or t
  misc_feature 53: w=a or t
  misc_feature 67: v=a or c or g
  misc_feature 68: m=a or c
  misc_feature 73: k=g or t
  misc_feature 79: k=g or t
  misc_feature 85: w=a or t
  misc_feature 151: w=a or t
  misc_feature 152: w=a or t
tbgcaacagtgttttcatctaaatagaattatacaaaatagcgatttctgatwtctcttgcatattvmacatkcttctkatactwcctccctacctttatctgacacagaaatgctgtatgtccagaacttctatcagaggcacctatggwwgtctaagggaagaccacatcgctt

SEQ ID NO: 34929 - DNA, 177 bp, Homo sapiens
catttaaagggccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgcccaa

SEQ ID NO: 34930 - DNA, 220 bp, Homo sapiens
  misc_feature 26: k=g or t
  misc_feature 194: k=g or t
cataggaaatgtcttagaattttatkattttttcctaaattgtgatgctatactacttgtatagctagttaccacatttctaaagcatagtgtgcctctgtgaatcttgttatatactgtttgggcttctgtaagatattttgaagtttgaaaagcaaatactgaaactttaaccaagagactgacacatctckttgtacaccacgttgcttctgtgtgc

SEQ ID NO: 34931 - DNA, 176 bp, Homo sapiens
tattcaaaagaggttaaataaggtctttccacagtaagtactggggtaagatctgaactcagaactcactcgattccaaattctgtcttctttcaggcaaagcgctggcgttaatatatggagataaatgagacagagttccagtctttgaggagctgatggtctagggagaagtc

SEQ ID NO: 34932 - DNA, 320 bp, Homo sapiens
  misc_feature 84: k=g or t
  misc_feature 173: r=a or g
  misc_feature 312: w=a or t
gcggctcggagcgcgaaacatggcggggcaggacgctggctgcggccgtggcggcgacgactactcagaggacgagggcgacakcagcgtgtccagggcggctgtggaggtgttcgggaagctgaaggacctaaactgccccttcctcgagggtctgtatatcacagagccaragacaattcaggaactgctgtgcagcccctcagagtaccgcttggagatcctagagtggatgtgtacccgggtctggccctcactgcaggacaggttcagctcactgaaagggtcccaacagaggtgaagatccaagawatgccggt

SEQ ID NO: 34933 - DNA, 290 bp, Homo sapiens
agcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagagagg

SEQ ID NO: 34934 - DNA, 354 bp, Homo sapiens
ctacactatcaaaccccccaatgatatacacatagcctttcaaataggctgccccatggtaggcacggggactctcttcctcacaagtaacattcacccatctgtctgcccgagcgtcatatgcctcaatggcattggtggggctcccaccactccagccaccaattgcaaagaggatggcatagggcaagcgtggtctggtgagtgggttggtgaaatcagaattagagggtccattcatgttgaggtcatacatggcctttagggcattaatgatgactggtttgcattcctcactgtctttgacatagtcattcatcttaacattgttcatgaagtactcagcatgcatta

SEQ ID NO: 34935 - DNA, 298 bp, Homo sapiens
  misc_feature 20: k=g or t
  misc_feature 21: r=a or g
  misc_feature 23: r=a or g
  misc_feature 24: r=a or g
tactttttcattcttaactkrgrratgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatac

SEQ ID NO: 34936 - DNA, 355 bp, Homo sapiens
  misc_feature 52: w=a or t
  misc_feature 227: v=a or c or g
  misc_feature 261: y=c or t
  misc_feature 274: r=a or g
ctggtattacatcaaacctactctggataaattttccagtagggcatctgawattgctttggcaaaagcaaaacaggttatcaatacaccaaggacatcaagtagttttaatgcaactacagtgttgagtgcttttttactgggagaaaaatcctagcagaacctgctactctgggcgcattaggtagttttatgcaactatagtattaagagttttattggaagavaaaacactgtcagagcttactgctccagaccgtyttttttaatagargagactggtaaaaatgatgcaggggctgaatgaaagccagctctgctccagtggctctctgagttgagcatgcatcagtta

SEQ ID NO: 34937 - DNA, 282 bp, Homo sapiens
ttctcgaatttcttctccctttctccctcttccccgacctccgggaccctccctttcgccccggctccccgggcccccacggggggcgtctcgacgctgtgcggccgccgagtttcggttgttccagaagaaacctgggaaacaaaagactatgtttggaacacgatgtggagaaagccagaacttattcaaacacttcagcagctgcaaatttcaagagcctactgtactgaaggctgttctgcagttacattcccctctgggagacagtaaactggccca

SEQ ID NO: 34938 - DNA, 175 bp, Homo sapiens
agtccaagtctccttggcaagacagtagcttagagaaacgagatcgaatgcacccggaaggtggccaatttgtgcctcaactccttggccatctcctagctaccaaactcaagcgtttcctccttagcaaaggcggacgtagggctcaaatccccgacgtttccagggccaaccc

SEQ ID NO: 34939 - DNA, 177 bp, Homo sapiens
aaatttattagttttttagaaacagtctctttctgtctccccaactggagtgcagtggctcagtcatggctcactgttgccttaaactcctgggctcgggcagtcttcctgtgttagcctcctgagtagctgggactgcaggcatgtgccaccatgcccggctaatgttttaatttt

SEQ ID NO: 34940 - DNA, 174 bp, Homo sapiens
cctataatgctatcagaaataattgctaaaattctaattttatgctttaaatatttttattgaaaaatacacaattatttaaatcttctaggtcatacagacatattttccatcaaaaagtttgtaccattttttactgtaatcaccactctccatgccaacaagaataccagc

SEQ ID NO: 34941 - DNA, 378 bp, Homo sapiens
  misc_feature 301: k=g or t
  misc_feature 302: b=c or g or t
acagtgaccgccaccgttgcccggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggctacccaaggtgcgaaaaagaaagaaggccaaagggaagaaggtggtgctakbccttgcggtcttgaaaaagcaggagaccatgaaagtggtgaatcttccatttgagaaatttggcactggacaggac

SEQ ID NO: 34942 - DNA, 187 bp, Homo sapiens
aaagtcagatgacacgtagagctttagggcaaaaaaaagaaacaaaagcttggtcaggacgtcaggaataagctgcttctgagagagggtgatgtcttcaccacagcagatcccccaggagaagtcatccttgtccagcggacacgcggaggcgctgtgctcatgctgggatgcagaccatgcccca

SEQ ID NO: 34943 - DNA, 197 bp, Homo sapiens
tttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacatcac

SEQ ID NO: 34944 - DNA, 172 bp, Homo sapiens
tgaattattatgttgcattgaagttaatgtcggtcttttgttctaattaaagtacaaacgtggcatctgaatagaagcttagctagagaagtggagttagagtccctattttaatgaactacatatatttttcaatcaaaatgtgtaattatttaattatctagcctgctct

SEQ ID NO: 34945 - DNA, 191 bp, Homo sapiens
gcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggccaaattcagataatcgacgccagt

SEQ ID NO: 34946 - DNA, 370 bp, Homo sapiens
  misc_feature 279: r=a or g
tgccctctccatatcctcattgtttttgttgcatttgtccttgactctaaaatcactgaagtattcatgattaggagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaraatggttatagattcgactgagctattactaacttctccatttgattttttatggatgtgaaaatgctgctacttgtctatgttattatgt

SEQ ID NO: 34947 - DNA, 228 bp, Homo sapiens
  misc_feature 63: s=g or c
  misc_feature 86: v=a or c or g
  misc_feature 113: y=c or t
  misc_feature 141: b=c or g or t
  misc_feature 147: m=a or c
  misc_feature 148: m=a or c
  misc_feature 150: s=g or c
  misc_feature 153: r=a or g
  misc_feature 193: s=g or c
  misc_feature 197: b=c or g or t
  misc_feature 201: s=g or c
  misc_feature 216: n=a, g, c or t
agatttgagagacacttgccattatctcatcattattttatcatgttagtgtacttgtgtaascttttatattttctaaatatgavaaatattttacagagattacatttgaygcagctgcttcctgaagacctagaggtbactttmmtsttrtaagcacattcttcagattgtcgtgtgggtgggtaacttscgcbagasttttctggagatggntaatccagccgt

SEQ ID NO: 34948 - DNA, 391 bp, Homo sapiens
  misc_feature 276: n=a, g, c or t
  misc_feature 326: s=g or c
  misc_feature 336: r=a or g
  misc_feature 339: y=c or t
  misc_feature 343: y=c or t
  misc_feature 349: y=c or t
  misc_feature 361: k=g or t
tatggtttcaggtcttagatttaagtgtttgatccatcttgagttgatttttgtataagatgagagatgaggatccagtttcattcttctatttgtggcttgccaattaacccagcaccatctgttgaatagggtgtcctttccccacttttttgtttgcttgccgaagatcagttgactgtaagtatttggttttatttatgggttctctattctgttccattggtctatatgcctgattttataccagtaccacactcttctggtgactatggncttgtagtatagttcgaagtcagataatgtgatgcctccagatttgttcsttttacttartcycacyttggcyttgcagatttgktctttttacttagtcttgctttggctatgc

SEQ ID NO: 34949 - DNA, 197 bp, Homo sapiens
taaaatgcttctcccaagtttaatttctctccatttgaccttttaaggatgtgaattggctttaagcagtagactccctttagtacggcgctgtgagcctctcagtgaatctgctacatccattccacccacgggtctggaaacttgtctgtttacctttccctaaaaacctaagatatatttttaagaagtgcctc

SEQ ID NO: 34950 - DNA, 326 bp, Homo sapiens
  misc_feature 256: r=a or g
taattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaraatagaggaggggaagaaaatggctcccttactggtcttagtaatcttctatatagttaatgagctaaaa

SEQ ID NO: 34951 - DNA, 325 bp, Homo sapiens
agttctaattttatgcaaaaagaggcaactataaccaaaaagctgaagagccacagaaagtgaactgcttttacttattcatttgagttgtattttactatattttgtttgctaatgaccacatacattctaatcacaattggaactgtttcaacccacaacttttcactcatcttcagaatggaagatatgaaggtaagattgtcagaaatgtggaattcacgggccagagggaggggatagacaaacactaaatgaccagatctctttctgggacacactgggcagggcctgtttgcagggaaagtgcagagatcctagggcc

SEQ ID NO: 34952 - DNA, 306 bp, Homo sapiens
cttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaatgagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaac

SEQ ID NO: 34953 - DNA, 339 bp, Homo sapiens
tgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttcta

SEQ ID NO: 34954 - DNA, 258 bp, Homo sapiens
  misc_feature 173: w=a or t
  misc_feature 220: r=a or g
tgatgctttgaaagagttattctccttcaacttatttctattgggtgagcacctcagctctccattgagaactaaggatctcaccttctaccaattcttttgtcccataatacatctgacatccttataaaatactttctagccctaacggggcttgtatacacatgcatgcwtgcactggtgcacacacacacttgtttcactaagaaaaatatgtgaragcttgtatatctttttgagtattaatttttgagcccc

SEQ ID NO: 34955 - DNA, 320 bp, Homo sapiens
  misc_feature 47: m=a or c
  misc_feature 285: m=a or c
  misc_feature 292: m=a or c
atctactttctacagtctgtggagacagggacaatgaagcctttgamgtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggamcacgggmtgtgtccactgctcctgatctgcagagc

SEQ ID NO: 34956 - DNA, 270 bp, Homo sapiens
  misc_feature 249: r=a or g
agtttttagtctcttaactatgtattaagtagaggtaatactcgtttagaaatgttgcttttatctgttgattatatagctgaggatataaacatttgttatctgataatttctaacaagatatgaatataccagagtataatctgtcataggagaggtcaagccaagtcttaggtctttcagttagaatttcatacaatagtacatttcccttttgaggtgtgtatcatactatctttagtgctagargtaatactttagccaagcaga

SEQ ID NO: 34957 - DNA, 83 bp, Homo sapiens
ttctgctgactacctacttatctgtcataactttgtttttattgtggtaagaacacaatgtgagatctagctttttttttttt

SEQ ID NO: 34958 - DNA, 464 bp, Homo sapiens
  misc_feature 71: h=a or c or t
  misc_feature 72: v=a or c or g
  misc_feature 278: w=a or t
  misc_feature 279: r=a or g
  misc_feature 353: s=g or c
tacagggaggggatccagagagctaaggggtttgcttcaacccatgggtgagtgagccaggtttggaggahvcaggcctacaggttcttaggccactgcattctctgggttcatggtgtgtccctataaaaggccaaggaaactcgatataataggcttcgctctctctggcacttcctagcttggtccattttaatcacaagccagctggtctgagggcacgggggtatgtgccaaggaagatggtatgtgggggtagaaatgggccactggggtcwrgtcaggtgtgagaagaggaagtagtaggagggaggagatgagagaagaagggcctgacggacttgtattggcascactatttgcatcaatatatgtgtatatatatattttttacagtgcacaaaggcctgcaagttctgttttgggctgaaggcccctatctgctgttaggactcctttgagga

SEQ ID NO: 34959 - DNA, 318 bp, Homo sapiens
ttttcttctcttttctcccccaacccattcagacacatgaccttccttaagtttcttcaatgtccatgcaaataccgatctctgacgaaggagcatccttcttctgggaagagcagccactacttcctctggaaaaccttccttaattgctttatatacttatattcacacataattttacataaatttaatgttatacattttctgtaatcattgtttttacctattttttcttaatgggaattgtatcacagtttgatctgggaagcagaacgactttaaatgatacagaaaagggattatcagccaggcgcgacg

SEQ ID NO: 34960 - DNA, 277 bp, Homo sapiens
gaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgctacc

SEQ ID NO: 34961 - DNA, 197 bp, Homo sapiens
acttcttgtaaactccaccagtctcttcattcttcacgtccccagctccccgtccccacctccccatacacaattgccctcgctttagcgctcccggctcccggcgcagagcccagggggctgctgtctcccacgtcactgctcaattatatgcaccgagaaagagaagggacagaccttcctggaggctccccctt

SEQ ID NO: 34962 - DNA, 236 bp, Homo sapiens
tttgtgtttctgtgtttctggtttcattctaattttgtcttagtttctggagtgatttttaaaaatttattatttctaaccctttctcgaatttcgttacctatgttttgtaagcttttttcttccactggactcattgggaactttccaaaattgtgcacaatttcatcattttatttcttttagctcattttgaataatttggctatagtttttatttactttgttgtcgtgtc

SEQ ID NO: 34963 - DNA, 207 bp, Homo sapiens
aaagagtagacgtcagtatagaccttaaaagaataatatgggaatatatgaatgtcaacaaatgtgatagtttggatgaagtgggcaaatttcttgaaaaatagcaaaccaacacaagaggaaataaaatctcaatatctctatatcttctaatgaaattgaaacagtaatttaaaatcacccagaaagaaaattctagactgtact

SEQ ID NO: 34964 - DNA, 272 bp, Homo sapiens
  misc_feature 218: k=g or t
  misc_feature 219: y=c or t
cctcctcctggcagcccagcaacaagcggccaccgcccccaccccggggcggtcaggttccgacctgaatctgaaagtgcttctaaaccccatgcttcacagaacgttcggagggggaggcgctccgtgggggctgctgcgtgcccatgtagccgaactgactcgaataaaagcgtgtccacgtctacatcacacatctgtgtaaatgcagaagcctkyggatgcgcggggctggccagacttcacagtgtgcagacacatgggctcatgca

SEQ ID NO: 34965 - DNA, 202 bp, Homo sapiens
aagtacaaaaaccaattagccgggtgcggtggcgggcgcctgtagtcccagctactccggaggctgaggcaggagaatggcgtgaacccaggagatggagcttgcagtgagccgagatcgcgccaatgcactctagcctggacgacacaaggagactccatctcaaaacaacaacaacaacaacaacaacaacaacaacaac

SEQ ID NO: 34966 - DNA, 181 bp, Homo sapiens
cctaagagtccctcttcagagaaaagggaatgattgcttttttttttaaggtacttacatttttgatcaatacaatctttcttaagatacagtaatattttccttctttatttctttccctccttccctccctccctccttctctctctccttccttcctttttcctttcttcttttcttt

SEQ ID NO: 34967 - DNA, 321 bp, Homo sapiens
  misc_feature 41: k=g or t
  misc_feature 61: r=a or g
  misc_feature 304: w=a or t
tctttgccaaggtcctggttaaaaaaattggaaacggtttkcttagccccagctttaaaargctagagatctcagagaaatagctggcttaacaatgacagaacagcttaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgawaacagtgttataatgca

SEQ ID NO: 34968 - DNA, 318 bp, Homo sapiens
  misc_feature 309: m=a or c
  misc_feature 311: y=c or t
ctttagaaagtcttctgggaagataagtatttcctataacctataatgacaaaataatgttttactagtaaaagcagctctgtacctcacactgtgaaacaattttacagttcttcaaaaaagagttcttcaagcacatctaggggatctagaggcccgtctggaacatcgaggttccagaggcacttctaggcgaaatggcattgtcagaatcccttcatgtggaggcagaattggggctcagcttttgtcttagtgctgtttttacccccaagagattcacttatgcttccataatgcaggaagaamcytcgcttt

SEQ ID NO: 34969 - DNA, 305 bp, Homo sapiens
  misc_feature 2: n=a, g, c or t
  misc_feature 3: v=a or c or g
tnvaaacgttgcaaagaccgggcgcgctggctcacgcctgtaatcccaacactttgggaggccgagatgggtggatcacctggggtcaggagttcaagatcagcctggccaacatggtgaagtcccgtctctactaaagatacggaagttggctgggcgtggtggcgcgtgcacctgtaatcccggctactcgggaggctgaggcaggagaatcgcttggacccgggaggccgaggttgcagtgagccgaggttacaccattgcactccagcctgggcaacaagagtgaaattcttgtctcaaaa

SEQ ID NO: 34970 - DNA, 274 bp, Homo sapiens
agccattcagctgatccgaggcaaagagccggcacttgccccagcccagcctgcttgaaggacctacaggtttgtctcttccagatcagaactgaggaacaaaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacgcc

SEQ ID NO: 34971 - DNA, 273 bp, Homo sapiens
  misc_feature 189: w=a or t
gcaacccgctcgggtccccttccacactgtggaagctttgttcttttgctctttgcaataaatcttgctgctgctcactctttgggtccacactgcttttatgagctgtaacactcaccacaaaagtctgcagcttcagtcctgaagccagcgagaccacgagccaccaggaagaacaaacaaactccwgacacgccaccttaagagctgtgacactcaccacgagggtccgcggcttcattcttgaagtcagtgagaccgataacccacctt

SEQ ID NO: 34972 - DNA, 189 bp, Homo sapiens
  misc_feature 30: y=c or t
  misc_feature 41: k=g or t
  misc_feature 46: b=c or g or t
  misc_feature 48: y=c or t
  misc_feature 51: h=a or c or t
  misc_feature 71: y=c or t
  misc_feature 84: b=c or g or t
  misc_feature 105: y=c or t
  misc_feature 118: y=c or t
  misc_feature 127: y=c or t
  misc_feature 131: b=c or g or t
  misc_feature 139: y=c or t
  misc_feature 152: y=c or t
  misc_feature 156: y=c or t
  misc_feature 159: y=c or t
caattttggaataggtgtggatgcggtgcygaaaaaaatgkatatbcygthgatttggggtggagagttcygtagatgtctatbaggtccgcttagtgcagagcygagttcaattccygggtatccytgtbaactttcygtctcgttgatcygtcyaaygttgacagtggggtgttaaagtctcccatt

SEQ ID NO: 34973 - DNA, 385 bp, Homo sapiens
  misc_feature 58: r=a or g
  misc_feature 59: k=g or t
  misc_feature 311: r=a or g
  misc_feature 358: r=a or g
tatttaaaaagcataatcaactccatgtctgagagcagagacagggaggagatgtcarkgtatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcatacagggcgttcactcagaccatctgtgctctgccctgagttcagttgagaaaatcctattatcaaatttggatttcctggccccagaacttcccaargacctgtaaaatggagggatttaccacctcacatatgtccagttaarcagtttgtggacttgtaaccgtcgcca

SEQ ID NO: 34974 - DNA, 251 bp, Homo sapiens
  misc_feature 240: d=a or g or t
  misc_feature 241: y=c or t
  misc_feature 242: y=c or t
cagctttagctcccttgtcttcaatgtgtaagtttgccggccaggtgtggtggctaacacctgtaatcccagcattttgggaggccgaggcaggcggatcacgaggtcaagagatcaagaccatcctggccaatgtggtgaaaccccgtctctactaaaaatacaaaaattagctgggcgtggtggcgcacacctgtagtcccagctacttgggaggctgagccaggataatcacttgadyycgggaggtg

SEQ ID NO: 34975 - DNA, 150 bp, Homo sapiens
tatcgtagggctatgcaacttgtacctgatatagagttcaagattacttatacccggtctccagatggtgatggcgttggaaacagctacattgaagataatgatgatgacagcaaaatggcagatctcttgtcctacttccagcagcca

SEQ ID NO: 34976 - DNA, 321 bp, Homo sapiens
  misc_feature 191: v=a or c or g
  misc_feature 213: r=a or g
  misc_feature 220: r=a or g
  misc_feature 221: v=a or c or g
  misc_feature 239: v=a or c or g
  misc_feature 262: v=a or c or g
  misc_feature 278: s=g or c
  misc_feature 288: m=a or c
catcaacatttaagagggttttttttaggtattctttaagatcttacaatctaaaaatggattatataagtttaatagaggattatggcagttagaaaaatggtagtttgaggtatcattctgaatcaaaatatttgctaaaatctgtctttagtatgtcagttaaggtgaactacatttaaatataagtvgtatatttatgttacacattarcttaaarvtgagtaattagatttttvaatgtttgttaactatacatgavtgacataccaaatgasatcttaaggmgagagagcacattcagtgtgacgtcatgaatga

SEQ ID NO: 34977 - DNA, 295 bp, Homo sapiens
  misc_feature 3: s=g or c
  misc_feature 40: s=g or c
  misc_feature 207: k=g or t
  misc_feature 217: w=a or t
  misc_feature 226: w=a or t
  misc_feature 231: s=g or c
  misc_feature 232: s=g or c
  misc_feature 250: m=a or c
  misc_feature 272: y=c or t
aasgtggtggggggtcgccagcaggttccctctccccggscccagctctggacgctcaccccagtgcaacgccctgagtgacggaaagaggtctggcggcttctctgttgacaactcagctggttccacaccctggcaattgtgaagagttggccaaatgtttgtccactgagctgatctcctctctggagcaccgaggccaccagkagggagccawgacaatgcwaactssagtgaacattcccgtgcmtgtgctccggctgtcccggggycctgatggcttcagcgtggcttt

SEQ ID NO: 34978 - DNA, 149 bp, Homo sapiens
tttattatggaaaactttaacatgtataaaaataagagctggtggacccttttgtcctcatcacccagctttatgatcagttttgtttcatctgtactaccagtgctacttaccatctctaggttcattttgaagcaaatcccagacca

SEQ ID NO: 34979 - DNA, 94 bp, Homo sapiens
tatgcacaatattagccctcattaagaggaaaaattttattacaatatgtaaaatgtgtgtgtgtgagagagagagagggagagggagagacag

SEQ ID NO: 34980 - DNA, 178 bp, Homo sapiens
actgggcaattgttggaactaagcagacttggagtggctgattctaatatgtgcctagaattacaatattgatccagatttttacattacctatccctcttgtttcttctgagcttgcatccagaggtcactggttggttcacaggaataagctgggtcagtctaaattgcagggaaa

SEQ ID NO: 34981 - DNA, 257 bp, Homo sapiens
  misc_feature 233: r=a or g
caaattgtcattctttatattttatacagagtttataattttatatatagaagggttagtctgatacaagttactatactactactggaagtgaaattttgctaggtatgtgttttaatgtatagatacacaaatttatttaagcttcatgattcacatactgctgtattccaatttaattcttaaattatgaggagaagaagtttgtgagaagtaggagtacagtttataaraatttatcagaaattatgagtact

SEQ ID NO: 34982 - DNA, 203 bp, Homo sapiens
gcccagcctccacgtctcgccgccaactccacatcctggctcctatctctgccttccaggcatctcccagctgcacgctcgggcccggctcagagccctaagccctgcctcccggtcctggccgggtttcccagaactgcacggcgcctctccgcccaggcccaagcgcgagcccctcctccacacccgagtcccagccccgc

SEQ ID NO: 34983 - DNA, 277 bp, Homo sapiens
  misc_feature 182: w=a or t
  misc_feature 183: y=c or t
cacagctgctggaaagattatctataatcttagaaacaccttgaagtatgccaagaaaaacgtccgtgcattttggaaactcagagccaacccacgcttggccaatgctaccaagcgtcttctgaccactggccaagtctcctcccggagccgcgtgcaggtgcaaaaggcctttgcgggawyaacactggcgatgaccaaaaatgctcgcgtgctgggaggtgtgatgtccgccttctcccttggctatgacttggccactctctcaaaggaatgg

SEQ ID NO: 34984 - DNA, 145 bp, Homo sapiens
attagaagtgttttccttaaagtcatacatgcatgtatcatgtaggatggttagtctagcatatgtgtgtttgtctttggagggtggcgtgtgtggaggatggtgtgtgtggagggcggtgtgtgtggagcgtggtgtgtgtgga

SEQ ID NO: 34985 - DNA, 167 bp, Homo sapiens
  misc_feature 76: r=a or g
  misc_feature 77: r=a or g
  misc_feature 82: k=g or t
aataagaaatacaaatctttagttagatcacatggcacctgactactgcttagaaaatggtaagacttactacatrratcakgagtcactattgacatctactatatcatatcataggttaggtatctaattataaatagtcaaatcagctgactcaaggtggcata

SEQ ID NO: 34986 - DNA, 284 bp, Homo sapiens
  misc_feature 205: r=a or g
  misc_feature 254: w=a or t
cacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatatractgaccacgctcaccctcatccagtccatactgatatttttgcaaggwactcaatccttttttaatcatccctcgcat

SEQ ID NO: 34987 - DNA, 174 bp, Homo sapiens
cctttaaggtcttttgaagtgttttagtgtatgcagttcccagtcatgctgttttgctgcaggtgtttgtctttttctttttcctctgccatctagctacattttactgttatccaggtgtctgactcttctagttgccacacacctaaattccatgttcacttctcatacctc

SEQ ID NO: 34988 - DNA, 203 bp, Homo sapiens
tctgcattctgacctgcaaccttggaaagagtgctggtactacaaccaggaagtgacagataatgtgctttaaactacattagaaaagcttctcatagcaaaactgagagattgaagcagtgattatttttacatagttgtcattaaatatttggagctctgctgtgcatagagatggcaacatacttagaatacacagtctt

SEQ ID NO: 34989 - DNA, 276 bp, Homo sapiens
actttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccaga

SEQ ID NO: 34990 - DNA, 236 bp, Homo sapiens
  misc_feature 58: w=a or t
  misc_feature 81: k=g or t
  misc_feature 93: n=a, g, c or t
  misc_feature 144: n=a, g, c or t
  misc_feature 153: r=a or g
  misc_feature 180: v=a or c or g
  misc_feature 208: r=a or g
cagtctaattttacgctgtagcagaaccagatggctgagaaattctggaactatggawcttgaccccaaggatatattatkttattccaaganagatcaggtaggcgaaaagatgacaggatacagagtcaatccataaactanatatttatractgttctgaattatacagagtctaavaatatgtgtcagctacttcattcctgtraatactcttgctgtgttataaatatggc

SEQ ID NO: 34991 - DNA, 349 bp, Homo sapiens
  misc_feature 39: w=a or t
  misc_feature 40: w=a or t
  misc_feature 330: r=a or g
  misc_feature 346: b=c or g or t
tcacctattttagaatgtggttgactacaggtaaccaawwccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaartaaatttattgcaacbact

SEQ ID NO: 34992 - DNA, 353 bp, Homo sapiens
  misc_feature 48: m=a or c
  misc_feature 190: w=a or t
  misc_feature 307: r=a or g
caccggctcctgcggcctgatggccaactaccgctacttcctggaggmtacgggccccaacagcacctcctacctcggctccaagatcatcaaagcctctgagcaggtcctcagcctagtggcccagtttcaaaagaacagcaagctctgacagtaaacctctcctaaagcacagggccccggctaagawaacgatcattttcaggaggggccgggagttatgtatctgaagcagctttccaagcaaagccaaagttgactgtgttcttgtcccgcagccggtccacactgtgaggccaggcctcarcttccctcaccctgggcgtgacatgcacccagtgcaagacggttgt

SEQ ID NO: 34993 - DNA, 226 bp, Homo sapiens
ccgaagccatgctggtccttttggataatgacacagcgttgaacgagacctggaaggcggagagaaaggttgagtacgcagtgtcattgggaggttagtgtacacatgccaagaccaacccagggaagccccagtgcctttcttcttcaagaagccttttcacactaaacaaattccctagactattcctgtctaaacactatcgcaatgacacgcctcccttgat

SEQ ID NO: 34994 - DNA, 55 bp, Homo sapiens
  misc_feature 2: r=a or g
arattattaaacacaattttttctttatccaaaatgaatgatatttcttttcttt

SEQ ID NO: 34995 - DNA, 247 bp, Homo sapiens
ttttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacagggcc

SEQ ID NO: 34996 - DNA, 56 bp, Homo sapiens
gctgagattgcgtcactgaactccggcctgggtgacagaaggaggctctgccttaa

SEQ ID NO: 34997 - DNA, 262 bp, Homo sapiens
tttttatgagagaaaaaaataaagctattgaaactataatatgacttactaatggcaggtcctgtgaaatgaaaagttttgcaatatagaaaaatattgtgttttctcctcatgtttctttgccgaaaggtacactttatcaattgtagtttattactaaagacttggaattccaactccaggaccctttccttctctacagaaatgccagtttgaattgtttatagtttgaattgttttgtgtgcttatagttatgtcagc

SEQ ID NO: 34998 - DNA, 291 bp, Homo sapiens
  misc_feature 163: s=g or c
ctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtsaccccctgcccaccctgacccgcctttacctcgcgtctagaggacacagccagggatcatcccgcagccccgaactccttcacagacccccactagctggggacgcagctcaggccccctacccccaa

SEQ ID NO: 34999 - DNA, 184 bp, Homo sapiens
  misc_feature 99: r=a or g
  misc_feature 148: r=a or g
atgtacataaataaaatatttattatgttgctgtcccaatttagatatgatgctttcctttcctcctgttagatgacaggtaatgatatccaatatgarattttcattatagtaatgcctaacatttattgagtgttgtgtgccagaraatgttctgagttctcctcattccaatatgtcaagt

SEQ ID NO: 35000 - DNA, 246 bp, Homo sapiens
ccagacaagtttatgcccaatcagcagttgttggtagttttaagaaaatccagaagataatctaggcaagctatttatcaagcaggctgtgcctttgtagagctgattgctggttttaatacagactatagagttgccatgtcacacaggagagtcagactcagcactgctttactttggagagccgtctgatcatggaatgcagtcaaaacccagcatttatctttggaattgaaatacgaagct

SEQ ID NO: 35001 - DNA, 244 bp, Homo sapiens
agaaagcatccaacccactgaaaagacaggcattaaaggagcttcgcctacagagctgctggaggatacactctccagggggttcctgttaaaaaccagagcttcagcttccaaaattacggctgagcttcagtttttccacaagagattgcctaaaggaaccatggagatcagaggggcactcgatctgcgaaaaaggcaagttctaatattccttgttttgctgggattgtctcggacaggc

SEQ ID NO: 35002 - DNA, 161 bp, Homo sapiens
  misc_feature 40: k=g or t
  misc_feature 59: k=g or t
  misc_feature 60: k=g or t
  misc_feature 76: k=g or t
  misc_feature 104: k=g or t
  misc_feature 145: m=a or c
  misc_feature 148: r=a or g
  misc_feature 149: r=a or g
acaggtttttctaaatccccttagaatggtggcaagattkctgccagaccatccacctkkgcaagtttggaatcckcttattggtgactatccctgcagtttckaaattaactggtaaaatgtatgtctgacaaggaggaaagamgarraaagcccgcata

SEQ ID NO: 35003 - DNA, 391 bp, Homo sapiens
  misc_feature 41: s=g or c
  misc_feature 307: r=a or g
ctttaaattcaaatcttcctgctatagtgtgaatgtttgtsttccccccaaatttatgtttaaactttaacctccaagctgatggtattaggaagtggggcttggggaggtgattaggtcatgagggtggaatatttgagaatgagattagtgcccttgtgaattaggcctgagagagatcccctcatctcaccatgtaaggacacagcagaaggtgctatctttgaaccaggaagtgagcccttgccagacactgaacctgccgatacctcaatcttgtccttctcagtctccagaactgtgagarataaatttctgttgtttataaaccacctagtttgtggtatttcattaaagcagtgtaaacagactaagacactccccatatgga

SEQ ID NO: 35004 - DNA, 361 bp, Homo sapiens
  misc_feature 121: m=a or c
  misc_feature 247: r=a or g
  misc_feature 317: r=a or g
aaaaatagcagtttgagatcgtatatgttaaatcttgaattgcatgatattgattatcagtgtagttcagattttgaaggaaagtaaaatctaatggtttacaagaggaattataattgamccaagagttaggagggccagggaattaatattttgttgagtatccacttgattttaggtgctttatgtggcattttcttgaatctatgtaatacttgtattaggtagatatcatacttgtgttatrgatgaggaaaataggttcaagtaacttctctagagtcatatgattagaaacagtggagtaaagatttgarttattcaacttgatgtcagctctctgctctctttgctccagact

SEQ ID NO: 35005 - DNA, 64 bp, Homo sapiens
  misc_feature 3: s=g or c
  misc_feature 18: k=g or t
  misc_feature 20: k=g or t
  misc_feature 27: s=g or c
  misc_feature 58: y=c or t
casgtaggaaatcacctktkacttagsttccagtagtcattaccaccttttactgcayaattca

SEQ ID NO: 35006 - DNA, 281 bp, Homo sapiens
  misc_feature 245: w=a or t
caggtgtaattaggatataatgtccttcaaatggcagacttaaagggggaaaaagtcactaaagaggtgaccagaagggttagagctgagcaagagaggttcctgccctgagccctgcattttagagtgcctaaggttacatacatacacacacacacgagttaaagaagacatggataccataaccagacacatgagttaaagaagacatggataccataaccaaagacattactaggaaagawaactaataccaatatcccttttgaatacagaggcgt

SEQ ID NO: 35007 - DNA, 290 bp, Homo sapiens
  misc_feature 189: r=a or g
  misc_feature 248: r=a or g
  misc_feature 266: r=a or g
caaaagtgtttattagttgcaatggttgaataatacagtattttcaaaaagttactctgggtctgggcgcggtggctcacgcctataatcctagcactttgggacgctgaggtgggtggatgacctgaggtcgggagtttgggaccagcctggccaacatggtgaagccctgtctctactaaaaatacraaaaaaaggctgggcgtggtgcctcacacctgtaatcccaagcactttgggaggctgargtgggtggatcacctgargtcaggagttcgagaccagtctga

SEQ ID NO: 35008 - DNA, 227 bp, Homo sapiens
ttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtt

SEQ ID NO: 35009 - DNA, 373 bp, Homo sapiens
  misc_feature 303: r=a or g
  misc_feature 356: n=a, g, c or t
tagaagaagctcattagctattcagaataaatttcatttttcttaatttttggtaatcatatctcagcctgttgaatttaacttaaactctgaaagaattttggttgccatttaatttttaggtttccttaatgatagggacctaataatttgttttaaaaaatttgtcttggctgggagcagtggctcatgcctgtaatcccagcactttaggaagccaacattggaggattgcatgagcccaggatttcgagaccagcctgggcaacacggtgaaacctcatctctacaaaaagttaaaarattaaccaacgtggtgccacatgcctgtaatcccagctgcttgggaggatgangtgagaggatttcttga

SEQ ID NO: 35010 - DNA, 116 bp, Homo sapiens
gatttggtgatccctttaagaaaccgcagcggaggaatttctctgagagaaaataatcctactcacggggccccttggaggccattaaccccccgagtcccggcccccaccccgtc

SEQ ID NO: 35011 - DNA, 306 bp, Homo sapiens
  misc_feature 209: n=a, g, c or t
ttgcaaagagaattttggctactttttgtttggagtcaaatataaaactaaacaacatgtgcccagatttcctaccatggatttgcaaaagctattttgaaacctttcttggcagaaatcatattctgttatgattcagtgttgcactgtaaacagagtgtttagaaattggggtttgagaagtgtaacggctagtttccttaaaaganaaaaaagattcaaatgcttggtttgcggctggagctttttgtaaattaatcaaattgagtgcagtgggaggggtgattcattaagtagagagctggt

SEQ ID NO: 35012 - DNA, 280 bp, Homo sapiens
taatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaaagcta

SEQ ID NO: 35013 - DNA, 253 bp, Homo sapiens
ttgtgcacttcgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagccc

SEQ ID NO: 35014 - DNA, 337 bp, Homo sapiens
  misc_feature 276: r=a or g
caaagaaattagtggctaaacgtagagaaattaagatgaaggaactggcacatggagccactgtgtactataaagtatttttattggtatttagtcttgctgttattgttgctaatgattgtattgaataattaccagctgttgttagttatttgaaattaggtgcctaaagcaacctctcatcttgcagaaagtcatctttcttgaaactttttaaaaacttgcttgaaacatggagacttggaatgggacgtctatcatagtagcacatctgaratccttctcattcctgctgtcatttctgtcctttcgcagtccactttgtcaccaccccctc

SEQ ID NO: 35015 - DNA, 226 bp, Homo sapiens
  misc_feature 103: s=g or c
gcccacgccatggcgccctaggagaacgcggggacagaactcttgctgcagagtttcgagcgccacttcctgggcggcgcgctcactgcgctccttcccctgscagagcttagaagcaaagttaagagactcatcagattctgagctgcggcgggatattttgcagaagactgtgaagcatcctgtgtgtgtgaagcacccgccgtcagtcaagtatgcccggtgc

SEQ ID NO: 35016 - DNA, 185 bp, Homo sapiens
aacacatggattttactgattcaattatggatgtgtgcaaagaatctgctgctcgctatatgggaacactttcagtttcccaagttaaaacatgaaattgcacatcatcatttggatccccaaagaggaaaagaaaaattcacaacctgccagtgaaatactcaggccacttggatgaagacgcc

SEQ ID NO: 35017 - DNA, 274 bp, Homo sapiens
  misc_feature 22: s=g or c
  misc_feature 67: k=g or t
  misc_feature 68: r=a or g
  misc_feature 69: d=a or g or t
  misc_feature 79: k=g or t
tggaactgctatcctgcgttasttacatgccaccaagccaatttactaaacaaccgtgggctaaatkrdtacagttttkctaattcaaagaaggcactcgttaattagataaaggctaaagctctcattatttttaaatgatttaagaacgggtaaagatcttacagcgtatactgcagctctaatagttctctgcttactgccttgtaataagagtattaaagacagatgggcaaggccgatttaaaccaattacagcgtttcatgtacacgc

SEQ ID NO: 35018 - DNA, 180 bp, Homo sapiens
tctccataaagtttgacatctgaccccagattctatgtaatcattattagaaattccttctctcattatttcaggattagtagttctgtgtaattcattttacaatttcaaattgttctggtgccataaagtatacagactactttaaagatttccaaatcccctaatttaccccacgat

SEQ ID NO: 35019 - DNA, 107 bp, Homo sapiens
agtccaacatggcggcgcccagcggagggtggaacggcgtcggcgcgagcttgtgggccgcgctgctcctcactgccacagtcagactttcagcttctcccggccca

SEQ ID NO: 35020 - DNA, 283 bp, Homo sapiens
  misc_feature 276: s=g or c
gcacaatgacacacacacattcaagatccacgctgggccagacgggccagagctgagccctggattcagacacctggacacacacggtccccagatccggcccaaccagaccagacccccagaaagatggacacgctcaagaaaggcaccccggcccggacacgggaaagacacacagagagaggcaggaagactcggtgacacgcactcttgggcaagaccgcgactcagacccccagacaccccgagagacgccgaagacccagacagagccasgcagccc

SEQ ID NO: 35021 - DNA, 237 bp, Homo sapiens
  misc_feature 22: m=a or c
taatttcattgttcaaataggmatttgatgtatcatgtgatagtgttttcaacatttacagctgccaaaagactatttattattattttttgctttttttctcttagacaagatggttaaataagtaattgcttaatttaagaaatgaagtatattttcgtgtattatttgtagaatcagtaacattaatttataattactctgggtataacacctaaaagttttctgtgagagcct

SEQ ID NO: 35022 - DNA, 377 bp, Homo sapiens
  misc_feature 327: r=a or g
  misc_feature 331: m=a or c
ttctgttctttataaattacctagtttcaggtgttttgtgtgaacagactgagaccatagtatttctttaatgtgaaaaaagaagcttgcaaagtcaacctgacatcatttagtttagtcagtcttacctagactataaataagtagaaattgcttatgcatgtaaagttacagaattaattgaaatggaaactttccaattataataggtctctctttctccatgttatgttatgaaagcctctgttatatcaggaaaaccccctgaaaattttctcatctgttgaggaaagagataacaggtaatcttattgggtttaagcttgraggmtaaatggaaacagcattcgtcttcaaatgaccaaaataatctgcaa

SEQ ID NO: 35023 - DNA, 61 bp, Homo sapiens
  misc_feature 11: m=a or c
  misc_feature 15: m=a or c
  misc_feature 51: m=a or c
ctctttccctmagcmgcctgaggtgatctgtgaacatggttcgctattcamttgacccgga

SEQ ID NO: 35024 - DNA, 281 bp, Homo sapiens
  misc_feature 35: s=g or c
  misc_feature 36: n=a, g, c or t
  misc_feature 89: k=g or t
  misc_feature 109: k=g or t
  misc_feature 120: v=a or c or g
  misc_feature 161: v=a or c or g
  misc_feature 162: m=a or c
  misc_feature 207: r=a or g
  misc_feature 269: k=g or t
tggttccctaaatcgccctatacatgaggctgctsnttatttccttccataatttgctttaaaatatgttaatgataaattctgttggkgtacaatacattgtattgcktctggtttgavatattcgtaattcttttgtaatgtttttaagatgatatcavmacattagaagcattcattttggattttatcattggctcttatggrtcaaatattataatttttatttaaatcaccgtttaatcgtggcatatgattacttatgtgtkcttttgttggta

SEQ ID NO: 35025 - DNA, 209 bp, Homo sapiens
ttgaaccatggatgtagaacacctgggctttactctcaagaagcacatcgtctactagtgtacacaaacaagtactcaattacatttgtaaaaatgagggccgggtgcggtggctcacacttgtaatcccagcacttcgggaggccgaggcgggcagatcacgaggtcaggagtttgagaccagcctggccagcgtagtgaaaccccat

SEQ ID NO: 35026 - DNA, 271 bp, Homo sapiens
  misc_feature 167: k=g or t
  misc_feature 168: y=c or t
  misc_feature 189: w=a or t
  misc_feature 190: b=c or g or t
ccatcctgacagcagcaaaaaagaaaggctgtgttttgctttttgtttcttttccctcccttagcagtgatagtagaaattgcttattgctggaaaatctgtatttgcctgctggtatgccattaaaaaagggatttggtagcctgaattccattttttctttaackyaaaacataaggggttgcattwbccatactggcagaatgtggaatgggtaggtgacttgaatgttgtcttttccacttagtattaccgttcaaaacccacgaat

SEQ ID NO: 35027 - DNA, 292 bp, Homo sapiens
  misc_feature 31: s=g or c
  misc_feature 104: y=c or t
  misc_feature 109: r=a or g
  misc_feature 110: m=a or c
  misc_feature 227: s=g or c
attagttaaggaaatggaaaatcatgcggastccagcaccagaaagcgggtaccattagtatccctcctttatcagtgaggaaactagagcacagagggttttyagtgrmcgtcacacagcaggctgttgacagctgggatctgaaggccctggaatggaaagattcagtctcatattgcccaattcggttcgctggactctgctcagcaagcagccgcgtgcgaasatgctcttgttcaaactaagtgagatggcctaggtgaaaatgcttcaggaaaagcacacaaatgc

SEQ ID NO: 35028 - DNA, 185 bp, Homo sapiens
tttgatgtataaaatgcaaataaaattagtttatcattatattctaatcttgaatattctaccatatttaaaaatatctcaaggtttctgttcattatgaaacatcaatatgttttctaccatttgtgaagaaatgaattttccagtttcaagtacctattcaaaattttattaaaaaccagcgg

SEQ ID NO: 35029 - DNA, 312 bp, Homo sapiens
  misc_feature 78: m=a or c
  misc_feature 123: m=a or c
  misc_feature 271: y=c or t
  misc_feature 282: s=g or c
  misc_feature 283: s=g or c
cataacgtcaacaacatacatttgcacatggaggagcacagcagatcatttttttcaggatggtaattagattaatgmtttgggaaacttaaaggtcttgggatgtgatgggactcattctgmggtccgtgctaattaagctaagcctgtcttttattcttctcaaaatttgggaggatacccaaggtctattttccttgccataaagaataaccacaaagctgtgaaaataagacaaaacagagttctcttacaaaattatctgtttgtyatatacttgassttcagttgagaaaaacggtacttgtagga

SEQ ID NO: 35030 - DNA, 145 bp, Homo sapiens
  misc_feature 30: r=a or g
  misc_feature 31: w=a or t
  misc_feature 32: w=a or t
  misc_feature 33: w=a or t
  misc_feature 118: s=g or c
  misc_feature 122: r=a or g
  misc_feature 124: r=a or g
  misc_feature 125: w=a or t
ctctctcatttttcttggtgtggcttgggrwwwttaggcttcctgttttatctcgtgtgtgtggtgcaccagctatgaggttgtctgtaacccaagccatcaaagggcctgtacatasctargrwgccatgagttgtcccggcct

SEQ ID NO: 35031 - DNA, 408 bp, Homo sapiens
  misc_feature 121: r=a or g
  misc_feature 131: y=c or t
  misc_feature 132: y=c or t
  misc_feature 134: k=g or t
  misc_feature 136: s=g or c
agattctgagccccttattcttatagattaaagattacatttcccagcctcctttgaagtcaggtgtggccgtgcaaccagtcctggcaataaaatgatagaatttttttttcttttttgrgatgggagtyytkgsctctgttgcccaggctggagtgcagtggcatgatcttggctcactgcacctctgcctcctgggttcaagcaattctcctgtctcagcctcctgagtagctgggattacaggtgcacaccaccaggctcagctaattttttttgtatttttagcagagatggggtttcaccatgttggccagactggtcttgaacttccaacctgaagtgatccacccacctcggcctcccaatagcaaattattaatgatagcaaattactatctgtgacag

SEQ ID NO: 35032 - DNA, 132 bp, Homo sapiens
  misc_feature 129: r=a or g
  misc_feature 130: m=a or c
ccatttgtttctcatgctcttaaaaaatgttattcagatcaagtggtttttcaattttttcctttgttctttctatttttaaatgttctttgaataccaagaacatttatccttcactgtaatatatgrmac

SEQ ID NO: 35033 - DNA, 362 bp, Homo sapiens
  misc_feature 119: r=a or g
  misc_feature 123: m=a or c
  misc_feature 129: m=a or c
catattgtcttcctttgttgctcaagttcttccaaagtcaattcatacaagcagatcttatttcttcgtagcttcagtggagcaaagtgacttatcagagagaactgaaagtctattgracamcttctmatcatgagtttcaacgtttgatttccttggtattagaggtctttgagcttcattggtgaagtcattacataactacttgttatgcaagtgtagcagatgatgtagtgaatctgtacagaaaattaaatgtatgacctgggaatgtttatttaacatgtttgatggtggcatcactagtttacaaaaggagcagaactttggttgtgaaatattttagtacatcctatggcact

SEQ ID NO: 35034 - DNA, 299 bp, Homo sapiens
  misc_feature 80: s=g or c
  misc_feature 124: n=a, g, c or t
  misc_feature 126: r=a or g
  misc_feature 131: r=a or g
acactaagtgaatttcaacttttcatttttcgacttacctcttccttgaaaagattttgtctgtttttgagtgagcggasttgttctgcttgtcttcatgtcgcatctcctcctctgggggctngraagtrggcgatcaagtcctgtagggtctgcaggacttcttctataggcagggtgatgggggcagctgtgcgattgtttccgctaaaaaccatgagattgacatggtttaggcaccggccagcagcagggccctgatgaacacccactgggtcccactcctaacagccccccac

SEQ ID NO: 35035 - DNA, 327 bp, Homo sapiens
  misc_feature 114: r=a or g
  misc_feature 120: m=a or c
  misc_feature 121: y=c or t
  misc_feature 125: s=g or c
tacaggctccatcatccaggcagtggaggaagtgtactgttagctcaacacgcatgagagatcaggctcatatacatggacacaccgacctgtgcaactctgcagccaggctgrcttcamyttgscctttggtttaatatcagacacaaggagcctggctatgagggtctggtggggactggagttagtataatgcgtctggcacagtgacagccatgcagggatgacccagggtttcccttgaccttgctgctgactctgtagcttcgacccacagctgcttcctgagtggacactgcgtgagtcacactgggtctcgtgcttggt

SEQ ID NO: 35036 - DNA, 247 bp, Homo sapiens
  misc_feature 121: d=a or g or t
  misc_feature 129: r=a or g
  misc_feature 130: m=a or c
ttaaaatagtccataaaattgaattaagcttctatgtatatgccttgtgatgtcctaataaaatgattgatgcagtcaggatatgcaagttttaaaatgttaccatctacactaaatctadcagtaatrmcatctaaataggaggtaaaatgagaggtggcttgtataccttcttggttgtctttccttctctcactttttacagaacttcttcgttttcctgctgcttctcatcttcacttttttt

SEQ ID NO: 35037 - DNA, 302 bp, Homo sapiens
  misc_feature 145: w=a or t
  misc_feature 205: k=g or t
  misc_feature 272: w=a or t
  misc_feature 300: d=a or g or t
  misc_feature 301: n=a, g, c or t
  misc_feature 302: s=g or c
aggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgwaaggtgtcttataatcttttacctatttcttacaattgcaagatgactggctttactatktgaaaactggtttgtgtatcatatcatatatcatttaagcagtttgaaggcatacttttgcatagawataaaaaaaatactgatttggggcaaadns

SEQ ID NO: 35038 - DNA, 138 bp, Homo sapiens
  misc_feature 113: r=a or g
  misc_feature 114: w=a or t
ttccctgccactcctctgctcgattatgcactggaagtagagaagattaccacctcgaagaagccaaatcttatcctgaatgtagatggtctcatcggagtcgcatttgtagrwtttaaccctcctacaagcctcaga

SEQ ID NO: 35039 - DNA, 110 bp, Homo sapiens
cagtatgagagtaggtgaggaacatagtttgtgtaatataatctttatttgcttacctgaccactttttattaagctgttttgtttaaaagcttttggttataggcatga

SEQ ID NO: 35040 - DNA, 458 bp, Homo sapiens
  misc_feature 122: r=a or g
  misc_feature 128: s=g or c
tccatcattctaccatttcaacttcattggcagtttacagaacgtttttggcctgtccataatattcattgcaaagcattctttgccatcttgaatatttcatccctagtagtttgttttgrataacsatccagccccatggttattagtacttgtgcactgaggactcctagatttaggtctagcccagagctttctgaccactcaacacatacatcttaatacattccaacagaattcccagtttttgttctctttgcatgtcagtaaatgactgtagttgcttggatttaaaccttattgtcttccttggcctccttttttctcacaccacgtgcgctctgttagccacttctgagggctagaatctgaccactgcttaacaccttcactgctacgaccttgcctgagttgtttcctaaggagccagagggagtctgttaaaatgtactcggaaa

SEQ ID NO: 35041 - DNA, 337 bp, Homo sapiens
  misc_feature 195: n=a, g, c or t
  misc_feature 196: n=a, g, c or t
taatttaaaccagtaataaaaacccctttctaggccaacttgtagcctagagagagagagtggcttatgaaagttcacagcagttcagtggcagagtcaagacaaaatgtcagaataatttaattacaggtcattgctcttttccagtgcacccacttcagaagctgtgatttcactatacgtacttggaaatcnntggtatttgttagctattattttgaagaaattattaagatgttaaatttcatgatctttatattaaaatttcaaacaaataatttcgtactaaataattatattaaactttcatagtttcctttcttttcaggaaggagat

SEQ ID NO: 35042 - DNA, 87 bp, Homo sapiens
  misc_feature 7: s=g or c
  misc_feature 17: m=a or c
  misc_feature 25: y=c or t
  misc_feature 78: s=g or c
aaaaaasaaataacacmagtcctaytcaaactattctgaaaaatagaggaggagggaatactttcagactccttctasgaggctagt

SEQ ID NO: 35043 - DNA, 455 bp, Homo sapiens
aagtatttgacacaccccacagattttacatgtgtgtaaatgtttcactttaaaatctctatgacagatacacaggaaacatgagatggtttctgctaatgagtggcccttgagtacacacttagatgctgtctgccctgtaaatttggatctggtgccccagggcagtcaactcttctagcacaggctgaaaacacgtgtgtgtcaactgaggttcacaccacttggggaatgagcctgttttctttccaggtcaggccctggtgtgagatcaattttagggctcctaattggagcacagaaatgtatttggtcaaatttcattgaaggtgatttcttcctttttctgttgtactttatggaaaaaccaagatggaacctgaaagttaatgtatccttgcttttagcaagagactcagtttcttataactagtcctaaggacatatgccgccga

SEQ ID NO: 35044 - DNA, 150 bp, Homo sapiens
atttatttgcccctgttataatacatatatagtaaagggagtaaaacaaatttaaaataaaaaacgtattaaattataaaatatattcctatttttataaaatgtagaaaggatatatgacttctgattgagatgttaaagtgagctcaa

SEQ ID NO: 35045 - DNA, 408 bp, Homo sapiens
  misc_feature 118: m=a or c
  misc_feature 125: m=a or c
  misc_feature 126: m=a or c
  misc_feature 133: k=g or t
taaattaaaaataagaagctatcttcttcctatcatcattcatagataaatggtgtgggtcatctctatatttaatcagtgtgtatgttgccatcatcctttcagacactacaatccmagtttammaggtatkgtttctcaaaaatatttctgatttcagaagagcacgttctttgagtatgtatataactagagggagaagtagaggagattcaattagccaatatatttgagcacatctatttaatttcaaagacttgcaagttgaatcccacagaatttgacctatgggatacctgtgttaaaatatcatattgattttttagttttgcattcaattgttctcactgaagaatataatatgaaagatatgaaataatgttttaagagaataaatacaggacacgt

SEQ ID NO: 35046 - DNA, 286 bp, Homo sapiens
  misc_feature 123: r=a or g
  misc_feature 193: k=g or t
atgtcttgcaaacagctttgatgttttcatcttttgtaaactgagaatttgaaatagatgatctctgaagtcatttttcactgtaagattctctctctgtatctgaagtggtgttttcagtgratcattaaaatgagagtattgtaagtaaaaacagactaaagtacagagagaatctcactgtcactgtgtktcactgcagggtcttttgtaggtaaagtgatctttctatcattttaacatctttaacatccctaactttaaagtacttttttgtccatcgccc

SEQ ID NO: 35047 - DNA, 420 bp, Homo sapiens
  misc_feature 119: s=g or c
  misc_feature 122: s=g or c
  misc_feature 281: r=a or g
  misc_feature 282: k=g or t
  misc_feature 335: r=a or g
actgttttattttttattcattccaagaaagcttagcctatttcatttaagaagagaagttcaagggactgaattattttaagagtaattctaagttgcactataacgcttaagcttgstcsttcaaggatctcaaattcagtgaccttagctcctccagtaaaaccggtgttaaacaatctcttttacttaaaatgtgttagtatttgatagatttgctgctttcttggcacatcctaaaaaagcaacaattaaaataataaggcagaatgcaatatgtrktttaaaaataagagacaaaataatacaacaaaccagtctgtaatattagagartaatatgttagtctaccaacagggcagacttcgagttcaatagaaaactcacttcgtgtgtatttacatatgaacgttccctttt

SEQ ID NO: 35048 - DNA, 339 bp, Homo sapiens
  misc_feature 121: r=a or g
  misc_feature 132: d=a or g or t
  misc_feature 135: k=g or t
  misc_feature 279: d=a or g or t
  misc_feature 312: r=a or g
  misc_feature 313: k=g or t
gagttttttttagaaagcttttacaagattacaagaaatgactctcttagggaagaaaaataaccacccagtttcccttcctagtcttagttcaattcatagagtgttgtgtttatccccraagggtctggdagkcttcactgcaaacatttgattctgatctactcacatacaaggaaatgtagattgccaagaccaaaactagagggggggcttcccatcagggttttcctgtgtggagatgacaggggaaacagggaggaaatcctaattatggcdtgtcctcttccctgaattgctgtctacgacagrktagttccaatgtaaacaaggtgggtt

SEQ ID NO: 35049 - DNA, 104 bp, Homo sapiens
  misc_feature 29: h=a or c or t
  misc_feature 39: s=g or c
  misc_feature 43: y=c or t
  misc_feature 63: m=a or c
  misc_feature 74: s=g or c
  misc_feature 81: n=a, g, c or t
aaaatcgggcgggaagaggtaaaaaagghactgggagcsagcygcggcggttcctgtccttamagttgcgctgsccagggnccgatgttgcgcgaggaaaatgc

SEQ ID NO: 35050 - DNA, 312 bp, Homo sapiens
  misc_feature 111: r=a or g
  misc_feature 126: s=g or c
  misc_feature 134: b=c or g or t
  misc_feature 188: n=a, g, c or t
  misc_feature 204: y=c or t
  misc_feature 205: y=c or t
gtttccgggtcggttctggcaggtctgagcgctccgacttccagaggagcgctgtgcacgtggagaagagcggggactcggcgaccctgccctcccgaccctcatgttcgragagcctgagttggscgaggcgbcccagtagccgcgggccttgggcccgtaatctcacgacctccgcctgcggcctnctcgcaaaacaagggyycaagcgccgccagctcttggccacattacgggccctagaggcagcatctctttcccagcatccccccagcctatgtataagtgactctgaggaggaggaggaggaaa

SEQ ID NO: 35051 - DNA, 382 bp, Homo sapiens
  misc_feature 124: y=c or t
  misc_feature 127: r=a or g
  misc_feature 131: s=g or c
  misc_feature 133: y=c or t
  misc_feature 146: w=a or t
  misc_feature 147: k=g or t
cattggaactagctgagccgaactagttgcggccaccgagcagccggctctcggcacctcctcctccgcctccctgtctcctgttccattcgcctttcctcttctttcctggcccacgccggtycgraggscytcgcgaccgccgwkcctgcagcctgccccgcggccaacatgagcttcttgtttggtagtcgctcttctaaaactttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggatttcttcaatcagatcaacatgca

SEQ ID NO: 35052 - DNA, 397 bp, Homo sapiens
  misc_feature 116: s=g or c
  misc_feature 124: k=g or t
  misc_feature 126: y=c or t
  misc_feature 130: h=a or c or t
  misc_feature 138: d=a or g or t
  misc_feature 362: k=g or t
cctatgcttctttgtacacagatcagccatctttttatctttttacaggatgaatcagatccaactactcctctgcatgtaactttcccagtgctttcacacacttggaagagagsgttccaaktyccchgtggtttdacaggccctgcgtggcctggctcctgcccctgcccaactcactggccctctccccaccactcacccctcactctgcctcagccacatgggagcagttacttgaacacacagaaccctttcttgccttaggaatgtggtattacctattggctctgcctagaatgcacttgcccctgtcctcacagaactgattccttcttattggtcacagcttagcttaaagkcacctctgtagaaaagccactcagacacgactgcc

SEQ ID NO: 35053 - DNA, 117 bp, Homo sapiens
  misc_feature 60: n=a, g, c or t
ttttagtactttaaggatacttgaagaaagtagcaccttgaggttgtcattattcttgtnacaatatgtgaatatgttaaattggaattatgttcttaaaaactgaagtctgttgca

SEQ ID NO: 35054 - DNA, 361 bp, Homo sapiens
  misc_feature 130: s=g or c
  misc_feature 137: m=a or c
cttcccaccctctgccccatctgctactccatgaaacagaatgctcactccgtttgcatctctctggtttggttgtgtttgagatagaactttcaggacttttatgacttgccaacatgacttcctgggstcaagcmagaatggttttgctgctccatgtgatattagctgggatcacttaagagatttgttctgctgggaactcagcttggcctggaacatcgaagaagacggagtctttctctgtcccccaggctggagtgcagtggtgtgatcttggctcactgcaacctccacctcccgggttcaagtgattctcctgcctcagcctcccgagtagctgggattacagtcgcccgcc

SEQ ID NO: 35055 - DNA, 190 bp, Homo sapiens
  misc_feature 38: s=g or c
  misc_feature 80: m=a or c
  misc_feature 111: s=g or c
tagatttgtccaaattgacttctgatctgaggccagasacaaccacagggcagagctggagactgggctgttttgaaggmagaaggactggcagaccagctcttgggaaasctccattattgctgtgggaggctggacctgaacttgcacctatgaacaaccctgccatttagagctttttcctgaggcc

SEQ ID NO: 35056 - DNA, 300 bp, Homo sapiens
agaggaggacgcgggcggcccggagcggcccggggacgtggtgaacgtggtgttcgtagaccgctcaggccagcggatcccagtgagtggcagagtcggggacaatgttcttcacctgggccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgt

SEQ ID NO: 35057 - DNA, 207 bp, Homo sapiens
  misc_feature 127: k=g or t
  misc_feature 131: k=g or t
  misc_feature 132: k=g or t
  misc_feature 138: k=g or t
  misc_feature 177: k=g or t
taaatttgtaaatcctaattcaaagatggctcatgtgtgagggcattgagtttgatttgttttccctttggtctgggttgtgtggcttttgggggatgcgtgtgagggggctatgtgttttttaaaktttkkaaatakatattttggtgctgtgtgtggtaagagacttgttcctaktggatcaatgaaccatctcttctgggcgta

SEQ ID NO: 35058 - DNA, 147 bp, Homo sapiens
  misc_feature 127: w=a or t
atttcttttctttctttttgaaacagaagttcatgggcaaagtgtcagggccctgccaggagaagtggtcgtgccaggtcgaggcgggggaaggtggaggcaggagagaaaggcttaggcaagaatwaactgtgtttttttgttttt

SEQ ID NO: 35059 - DNA, 444 bp, Homo sapiens
  misc_feature 117: k=g or t
  misc_feature 128: m=a or c
  misc_feature 131: y=c or t
aaaaaaggcagagatttacaagccaaggaatgtcaaagacggccagcacaccaccagaagctagcagagaggtatggaacagattcttcttcacaacctcagagggaaaaccctgckgataacttggmttycaaactcctggcctccagaacgacaaagtcttgcttgctctgtcgctcaggatggagtgtagtggtatgatcttagctcactacaacctctgcctcccaggttcaagtgattctcctgccttacgctcccaagtaactgggactacaggcacacaccaccacacccagctaatttttgtattttttgtagagacggggttttaccacgttagccgggctggtcttgaactcctgacctcaggtgatccacccgcctcgatcgcccattattaacaatcaaatggctgttcttcatggtactggtacaaaaaca

SEQ ID NO: 35060 - DNA, 216 bp, Homo sapiens
  misc_feature 118: w=a or t
gaaaaacaagcaatggggaaaggattccctatttaataaatggtgctgggaaaactggctagccatatgtagaaagctgaaactggatcccttccttacaccttatacaaaaatcaawtccaagatggattaaagacttaaacgttagacctaaaaccataaaaaccctagaagaaaacctaggcattaccattcaggacataggcatgagcaagc

SEQ ID NO: 35061 - DNA, 171 bp, Homo sapiens
  misc_feature 117: r=a or g
  misc_feature 119: r=a or g
  misc_feature 120: r=a or g
  misc_feature 121: r=a or g
aacggacgcgaggcgcgcgccatggaacagcggttagctgagtttcgggcggcgcggaaacgggcgggtctggcggcccaaccccctgctgccagtcagggcgcacaaaccccaggrgrrraaggcggaagcagcagcgactctaaaggcagccccaggctggctaaagcg

SEQ ID NO: 35062 - DNA, 299 bp, Homo sapiens
cgtaacactacatgtacacatacactacattacccactacagatcagtagtttcctgtcagtaaacaatctttaaatgcagttttactatttctctttttttcatgttaacattatttctagtttaatgcataaattagtagatctattagataatttatgattttttcttgattgattttcaaggccttaaaggttaataattgttagtattgataccttaccttctcatattgttcatgacaatagccagagctattctttcaaactagttagctttctcttttatttattgtattt

SEQ ID NO: 35063 - DNA, 180 bp, Homo sapiens
  misc_feature 42: s=g or c
  misc_feature 50: r=a or g
  misc_feature 55: r=a or g
  misc_feature 58: r=a or g
  misc_feature 84: r=a or g
  misc_feature 122: k=g or t
  misc_feature 142: r=a or g
  misc_feature 151: r=a or g
ggaggcccgccccctcccccctgggtcggacgctgagcggascgcgggcrggagrgcrgacggaccgactgacggtagggacgrgaggcgagcaagatggcgcagacgcagggcacccggakgaaagtctgttactactacracggggatrttggaaattactattatggacaaggcccc

SEQ ID NO: 35064 - DNA, 107 bp, Homo sapiens
gtatgatattaaattctgtttttgtagggtgttataattacttcaaaagatataatgttggctgggtatggtggcttgtgcctgtaattctagcactttgggagata

SEQ ID NO: 35065 - DNA, 259 bp, Homo sapiens
  misc_feature 118: n=a, g, c or t
ccagagtttctaaaaattttttggagggaggtacctaatagaagaatctagacttagaaatgtgaactgtggttaaataccaaacccagttccgcagtggtcatctaaagcgtctaanactggagtgttaagaaaacccagagacattcatatagtttcagttatcagagtattagaccagactttatttgcaatttgttcaacagagagattttattttgatacagatattaagcataaagcatagtaagttttatat

SEQ ID NO: 35066 - DNA, 340 bp, Homo sapiens
  misc_feature 78: v=a or c or g
caaagattattgaaacagtcgcagaaacgagattattataaaatcttgggagtaaaaagaaatgccaaaaagcaagavattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggacccc

SEQ ID NO: 35067 - DNA, 246 bp, Homo sapiens
caattgatagatgaacttttaaatatttgtagaatgtatattagtgttgccaaattgaaattatatctcacttgtcttattattgaattacatttatcctgctttgcagattttataataatctcaaaaagaattgactgtagttgtctccagtagacttttaaaaaattgtcaattaaggttaccttctttagaacttgttctctttatttactattatgtttaaactcattttacctgtgctaa

SEQ ID NO: 35068 - DNA, 246 bp, Homo sapiens
  misc_feature 206: s=g or c
aaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaascaaagtaaatataatattatcagtaactttatccccagta

SEQ ID NO: 35069 - DNA, 378 bp, Homo sapiens
  misc_feature 289: r=a or g
tatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaarattaattcattagattgaaaaatgtattctatatttctgatagactggacagaaggatctgtgtccccaagtgagacaggctctgaata

SEQ ID NO: 35070 - DNA, 264 bp, Homo sapiens
taattttctagttccctgaccacctatggtagacttcgtaaatctttgttgagttacttctacagacacttatggacttcactatagtggctctcaaccaagaataattttgcaccatggggagatacgtggcaatctctagacacaatttttatcatccccactgggaaatgctactggcatctattagataaaggtcagggatactgctaaacatactagaatgtacaagacagcccccaccacaaagaattttccagcctc

SEQ ID NO: 35071 - DNA, 375 bp, Homo sapiens
  misc_feature 357: k=g or t
taaacacttagaattttctaggccctggggatccagcattgaacccaacaaggtccctgctgtgactgagcttacagtctagtaggaaaagatggataataaacaaataaatcattatatattatatcagagggtgataaatgctgtggtgaataataaagcagggagagtctagggaggggtccagagagttcccggaattccctccctaatgagatgatctgaagaagatgaaggaacaacctatgtagctttctgggggaagacatcccaagaagagggcagggcagccctgaaagccccagagcagtggtgtgttgagagtgtttagtgaacaaggtggcaaggaggtcagtkgctggagcagcgggagac

SEQ ID NO: 35072 - DNA, 229 bp, Homo sapiens
taagtacttctaatattgtagatttctcagatcattactgttacaaggggcggcttaaaggtagaactcttaaaatattattatcatctattctgccttcctggtttgtagatacagagacatcccagagaggttgtgatttatccagatttccacatcaagttgagattacagtggagggtgcgttcgaaagtaaaaataacttctccttttgaattttgatggctat

SEQ ID NO: 35073 - DNA, 273 bp, Homo sapiens
  misc_feature 53: k=g or t
  misc_feature 54: y=c or t
  misc_feature 56: m=a or c
  misc_feature 57: w=a or t
  misc_feature 71: w=a or t
  misc_feature 78: k=g or t
gataattttgatgaaaccaagaggcacgtctttctacatacttctcttcatckycmwttcctagtgttttwgtttatkttttttaaataatgcccatgtctcctgctgtcattctctgagaccaccaaatagtttaatacctggagtcagagataagaataaacaggcttaagatactttaaataatgttcaatactatatacttggtcatatcattagtgagcatatttttcttttgggaagtaactaatgctttccttaaggccaggcgtt

SEQ ID NO: 35074 - DNA, 331 bp, Homo sapiens
  misc_feature 55: y=c or t
  misc_feature 56: w=a or t
  misc_feature 58: m=a or c
  misc_feature 59: r=a or g
  misc_feature 241: r=a or g
acagtataacacagttacgttaccatttgcaaacctaatgtctaatgcccaatcywamrgatttcctcaattttcacaaaaatggcattttacagttcgtttatttaatattacttccaggctggacatggtggctcacgcctgtaataccagcatttgggaggccaaggcgggtggatcacttgagtccaggagtttgagaccagcctgggcaatatggtgaaaccccgcctctactaaraatacaaaaattagccgggtgtggtggcacacacctgtaatcccagctattcgggaggctgaggcacaagaatagcttgaacccaggagc

SEQ ID NO: 35075 - DNA, 176 bp, Homo sapiens
  misc_feature 101: s=g or c
taaggaacttgaaaagctaaaaaatcagaattccttcatggtgtgaagatgtgaataattgcacatggttttgagaacaggaactgtaaatctgttggccsaatcttaacatttttgagctgcatttaagtagactttggaccgttaagctgggcaaaggaaatgacaaggggaca

SEQ ID NO: 35076 - DNA, 82 bp, Homo sapiens
ctagcctttgttcaagccactacccccacctggaagccggcccctggccacctttctttttctttttttttttttttttttt

SEQ ID NO: 35077 - DNA, 455 bp, Homo sapiens
  misc_feature 137: s=g or c
  misc_feature 138: h=a or c or t
  misc_feature 319: m=a or c
  misc_feature 365: r=a or g
  misc_feature 366: m=a or c
  misc_feature 382: m=a or c
  misc_feature 397: m=a or c
  misc_feature 404: h=a or c or t
acttcattgtatacccattttggctccccactagctccaatgcaacagagaccagcaggtgccaaatgcacatttacaaatacaaatgactgtcaggtagctgtattgacagaatgcctctgaaaggttctctggcshtgaagtaattgcacatgcaccagagataaacattgagaggagatcaatttaaatttaatctgacatcatctactgtcacccagagcaagtgctaaaatatatccattcaatccatagcattgcaaatggggtctataatgtttaagataaagcctctgctagtttgttttatgagggccamagattatcacaactaatacagtatgaactgcttctgctagtcaagrmataatttatgattaamtcttaaatgtgagamattcachgaaaacactcaaaacacatttttccaagctgatttttttccactgtcaaca

SEQ ID NO: 35078 - DNA, 280 bp, Homo sapiens
catcaagaactgttgacataattaccttaatctccttacttccctcttttactgataacaggaggcagactactggaaatgtttattataaagatagacctccccccattgctaagatataatttagatacttataaattgtacacttttaaagtatgcagttcagtggctagtatgttcagagttgtgtaaccatcaccactgtctaattccaaaacatttttatcaccccaaagggaaaccatcaccaatcactccctattcctcctacccagcccct

SEQ ID NO: 35079 - DNA, 117 bp, Homo sapiens
  misc_feature 44: n=a, g, c or t
cttatcgcccggtacctatcggcgggcccgtgtcggagagcggnccaggtgctggtgcaggagctggagcagtaccagttgttgccgaagagattggactgggagggcaacgtgcac

SEQ ID NO: 35080 - DNA, 295 bp, Homo sapiens
  misc_feature 247: v=a or c or g
cgatgatctggatcttggcctgtcgatacagcgtccaggaggcgagatgcagggctaaggacttgtagctttccttacatttcattcacatcagttgtgtacaggccccatgctggggttcgtaggaatcccaaaccacccgacttatgtccctcccttcaggaggctcgtattagagggtgaggtgcacatgtaagcagcgagtatgcatgtgcccataattaaataagcgccttaggtgcaagcvctgaagggggagtgcaaagaccgaaccgtgtattctgattcaggagag

SEQ ID NO: 35081 - DNA, 126 bp, Homo sapiens
cacatccaatctggtttaagttcccatattattaggaaagctttagggtgcttcaggaaaacgctttttaaaaaatcaaatttggaaaatatcaaatggaattacaggcaataagcataacccagt

SEQ ID NO: 35082 - DNA, 242 bp, Homo sapiens
  misc_feature 71: n=a, g, c or t
  misc_feature 72: m=a or c
  misc_feature 73: n=a, g, c or t
  misc_feature 126: k=g or t
  misc_feature 137: w=a or t
  misc_feature 140: h=a or c or t
  misc_feature 212: k=g or t
actttaacttcctggagctctaatttctccttctcaggtagaagaatgccattcactcccaagtggtgagnmncaagcagccagtggtaggaagggtcatcaagtcagttgtcagaaacctcactkatgtcactgtwtahgctatgtgaccctgacctagttccttgccctctcttgatctcagttgctttatctgtaaaatttcacatttktcagcaagtcaaccttccatgttcctctca

SEQ ID NO: 35083 - DNA, 455 bp, Homo sapiens
caaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtactttagattcttgtaacactagtctgtact

SEQ ID NO: 35084 - DNA, 258 bp, Homo sapiens
  misc_feature 111: s=g or c
tcaatggaaatagaaaataaacaccataaaagagagaagagaggtaatttgttagcatcaagagtcaagttgctatatggtcaaaggttaaatttatctctaaaaaatggsaggattcaaagttgtacatacatgtgattacttctgttttttacacccacatacagtacaaaagattattaaaaatattcccaaaaggcaggtgcaatgatgcacacttatacccccagccactcaggaggctgatgcaagagtcac

SEQ ID NO: 35085 - DNA, 330 bp, Homo sapiens
  misc_feature 113: k=g or t
  misc_feature 114: k=g or t
  misc_feature 115: w=a or t
  misc_feature 119: k=g or t
  misc_feature 127: k=g or t
  misc_feature 134: d=a or g or t
  misc_feature 140: w=a or t
  misc_feature 191: w=a or t
  misc_feature 217: w=a or t
  misc_feature 293: r=a or g
  misc_feature 294: k=g or t
  misc_feature 297: w=a or t
  misc_feature 309: k=g or t
  misc_feature 316: w=a or t
caatagtgttgctttaaattgtgcccctcccaacatgcttgatgtttggcctgatctccaggcaaaaggagtgagatgaatcaaaaccagtgaacttttttttttaattgttkkwaaaktccctttkaacccadtgtacwaggtcaatcaggaggcatctggaaagggggggaaaaaagcaaaaaacaaawttaaaaaaaattgatttccatatttwatttttcaaaaccctaaaatattacaaaataagtcccgcatatactttaacgttttaactcttttggacaaaggarkcawttacttgaagtkgcttttwgtgactctgcccaa

SEQ ID NO: 35086 - DNA, 244 bp, Homo sapiens
  misc_feature 117: k=g or t
  misc_feature 244: d=a or g or t
tctagacagccaaggtttaaaaaagaaaaaagttttatgtcagtggtggttagggggtgacacaggcaaggcacaagtgatacggctccgatgagtgcaggaacactagggtttttkgttcttatgctggtttagataaaacgacaccgacacacgtggagtggttttaaggagcggagagtttaataggcaagaagggaaggagaaaggcagaaagaagaaagtacagagacagagggagttd

SEQ ID NO: 35087 - DNA, 365 bp, Homo sapiens
cacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtctt

SEQ ID NO: 35088 - DNA, 134 bp, Homo sapiens
  misc_feature 95: r=a or g
  misc_feature 96: r=a or g
  misc_feature 99: k=g or t
gcaagtgtttataatggagaaatccttcttattttaaaacttttctgcaaaattcaatacagtccacgtacacctaatggacacagatataatarragkacaaaaatcttagctcccattaaaaccttccctgc

SEQ ID NO: 35089 - DNA, 223 bp, Homo sapiens
  misc_feature 130: k=g or t
  misc_feature 139: m=a or c
ttttcacccttaaagtttgaggaggatcttgatatgttttaacattatcatggcagggaaatatataaagaagaaaaatatttttacattaaaccttttctaaaaattgtaaatagaaaaataatttggktttttatcmaagaacaacacttatcgttatgtattgtgttagttatattgccagtctgttgcactgactcaaaaagttaaatgttgccactgc

SEQ ID NO: 35090 - DNA, 215 bp, Homo sapiens
  misc_feature 9: v=a or c or g
  misc_feature 10: n=a, g, c or t
  misc_feature 132: r=a or g
  misc_feature 138: k=g or t
  misc_feature 139: r=a or g
gtactaggvnataataacgcctcccatttatcaagggtttactctgtaccaggcattgtgactgatgtaatttagttctcactgcatccctgtggcatggatattctcattatctgcattttgcagatggaraaattkragtctctgagaggttaaggaacctgcccaaagtcagcaatgcagtaccacttcttgtgctgggacacagcgggtat

SEQ ID NO: 35091 - DNA, 266 bp, Homo sapiens
gcggctgcggttccgagcggggtctggggctgttaccattgagtgaccagaaaggctctcggtgcaaagcgttcctgcagaattgcttccacgtaaagggaccttcgggaaatttcgctggataccggctggcattgacaaacccagcgtccctgagccttgtgaggtttccaggcaggctgattgcgaggcaacatgtctgcttcggtgaaagaaagccttcagcttcagctactggagatggaaatgctgttttctatgtttcc

SEQ ID NO: 35092 - DNA, 403 bp, Homo sapiens
tggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagc

SEQ ID NO: 35093 - DNA, 184 bp, Homo sapiens
ctactaaagccaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagca

SEQ ID NO: 35094 - DNA, 74 bp, Homo sapiens
gctgagattgcgtcactgaactccggcctgggtgacagaaggaggctctgccttaaaaaaaaaaaaaaaaaaaa

SEQ ID NO: 35095 - DNA, 359 bp, Homo sapiens
  misc_feature 310: n=a, g, c or t
  misc_feature 311: b=c or g or t
ttggtttctgtccttgcaatagtttgctgagaatgatggtttccagcttcatccatgtccctacaaaggacattaactcatccatttttatggctgcatagtattcccatggtgtatatgtgccacattttcttaatccagtctatcattgatgttcatttgggttggttccaagtctttgctattgtgaatagtgccgcaataaacatacgtgtgcatgtgtctttagtagcatgatttataatcctttgggtatatacccagtaatgagatcgctgggtcaaacgatatttctagttctagatccttnbggaatcaccacagtgtcttccataatggttgaactaatttacactccc

SEQ ID NO: 35096 - DNA, 292 bp, Homo sapiens
  misc_feature 83: k=g or t
  misc_feature 94: w=a or t
  misc_feature 96: k=g or t
  misc_feature 98: r=a or g
  misc_feature 112: k=g or t
  misc_feature 136: v=a or c or g
  misc_feature 142: n=a, g, c or t
  misc_feature 149: n=a, g, c or t
  misc_feature 150: d=a or g or t
  misc_feature 234: m=a or c
  misc_feature 235: s=g or c
  misc_feature 264: k=g or t
ctatggagggaagacacagggaaaggagtatttcaaaaactttaaataattgtacataattggagcaagtgagaagacaagtkagaggtaagcwgktrttgagaataggggkctgattgtgccagctttgtatacvattatnaggaacndggactttgtcctgaaggtaactgggcaattgttgaggtcaccaccatctactgtctggattaccgaggaaactttctaaatgtmstctccacttccagtcctgctcctctcatkcaatctcaacctaataattcagagtagt

SEQ ID NO: 35097 - DNA, 243 bp, Homo sapiens
  misc_feature 99: s=g or c
  misc_feature 105: k=g or t
tgttcttgatgacagcatatatgattgctctcaggtaaattttgatgcagtaaattcatgaccataacatctattacttgggaccatcttgccaagtgstccttkactccatgaaatatttaataaacactgctttaaacctggaaaagcacaatctacatttagtgaatatttcatagaatatttaactttttacattgattacgtggttcacttacaaaaatcgatggaagatacccccct

SEQ ID NO: 35098 - DNA, 344 bp, Homo sapiens
ggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacacc

SEQ ID NO: 35099 - DNA, 264 bp, Homo sapiens
  misc_feature 132: s=g or c
atggagttttcagtgcctgcgccggtggggacgaactggccaccgtagttggcgaaaatctggtcgccgtttggatacagcaggacgaacttgccattgctgaaggtgaatgtggtgccagactgggcgaasaatctcggccgacgaacgcgaccggcgttccttcggccgtctcaccgtggccggcaagcttgccgccgagcgacgacgcacattgcggcgcaggaccaactttttcattgaacacgcccttgatttcaagcg

SEQ ID NO: 35100 - DNA, 96 bp, Homo sapiens
atctaatattttgattgttttcttaactttctccttaaaacattcagtagtgataaagatatagaaactgcactgtaggagaattggaatatttaa

SEQ ID NO: 35101 - DNA, 120 bp, Homo sapiens
ttcatgcgcaaggagcacctgctgaaccaccggcggctgcacacaggcgagcggcccttcagttgtcctcactgtggcaagagcttcatccgcaagcaccacctaatgaaacaccagcgc

SEQ ID NO: 35102 - DNA, 343 bp, Homo sapiens
  misc_feature 131: m=a or c
ccccttcctctcgcagctggtgctgtggggccgcggaccgcgcgtcgctgtctctatggccccggatccgagcgcaaagaaaacggacctcagaaaaccaggactagctctactgtcgggggcagggtgamccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccct

SEQ ID NO: 35103 - DNA, 456 bp, Homo sapiens
catgaaatgtgcttggtctgtgatctcttggtcagatatctgccttccaggcgatcctttgaggttgtgtaattcagctggccctggctcctggtccctgttactgagctgggcagtcgaaccgaaggcagatgagctcaagatcatgccttgggaagcatggtgctctaggggtgcctttttattcctttcattgtattatagactgtttccaagtttatggttagaaatggtaaagtgggtctggtgttttgaggtagaacccagcctagggcaagatatgaactgttcttgaggtagaaatgtctacagtcagttgtttcatctagcttgcatcttaaaacacaaacccttcagttgctttcacttaatgcacacatttgccaatgacagagggttatacaggatccttcttttacatttctattgtctgctacgctcatcagagtatatttt

SEQ ID NO: 35104 - DNA, 111 bp, Homo sapiens
  misc_feature 10: m=a or c
gcttgaaggmagtatgcttggtaaaagtcatcgccattctctaatcttgagtacccagggacacgatacactgcggaaggctgcagggacctctgcccaggaaagccaggc

SEQ ID NO: 35105 - DNA, 164 bp, Homo sapiens
  misc_feature 66: m=a or c
  misc_feature 79: m=a or c
  misc_feature 80: m=a or c
tgtgttaaattctagatggcaccaatgtttctaacatatattgttagtcacatttccagtctaggmaaaggccaaaggmmaaaagttctattgcttgaaattgccctagtgaactggacctgcactatgcaatagagtagcccctagacaagacaagtgtgtct

SEQ ID NO: 35106 - DNA, 131 bp, Homo sapiens
atataagggaatttgcatttcgcttttcacggcaaacctttctgtgttttttgtaaatctaacaattgcaacaacatggaatatttagttgggagatgtttggagtaagtgttgaaagcaactatgtttgc

SEQ ID NO: 35107 - DNA, 286 bp, Homo sapiens
  misc_feature 84: d=a or g or t
  misc_feature 179: b=c or g or t
atttaattcatgagccttaaggagaggataggttaactggatcctagtaactctcttataatctggcctcttccttccttttadgtatcttcttctgcctctgactacctctgtgctccaaccagactaaatactatactctgtagtgagtaccctcctcccacagtttaccttataabtggaaagctgttctgctgtggaatcacgtgaccattccttcacttcatgctcaaatgtcaaggtctcagagaggccttcccaaatgaccatctaaaatagcaacccc

SEQ ID NO: 35108 - DNA, 412 bp, Homo sapiens
  misc_feature 29: n=a, g, c or t
  misc_feature 322: n=a, g, c or t
  misc_feature 346: n=a, g, c or t
caaaatcaaggtcgtgatgactcctgggnccaagataagtgaaaaatcatgagcagaaggttaaaaaaaaatggagctctctaactgcaatagtcctccccgaagcactgtgcaaaaaaatctctagaactcatggtttctacactggaaaagtgacattgaggtggatattcagcttgcccacaaacttgggttccttcacaagaaaaccattcctgcctcactccatgagaagaatcacaagtgcctgtagggtgaaaactcctgaggatagctagagaaaggatgaagatgtggctagcaccaccctgcacatgaaacntagtgcctcttctttattgcagcnaaaagagacatcaaatcagagaggctgtttagcagcaccacacagtaggtggcactctacagagat

SEQ ID NO: 35109 - DNA, 281 bp, Homo sapiens
  misc_feature 101: w=a or t
  misc_feature 204: s=g or c
ttatggattcactagacaaacagctgtttccttattgtcttttttctttagtgtttctgatttgctatcagtagctgtttttaaagccatccaagggaaawtaattatttacagtttttgaagtcacttttgagccctcatcaagctctcattgtgatgggagggatacctttttgttgttaaaagcctattattgttaaaggscttttatggaaaccaacttggaaaacaaccttaaatgtggatgtatcagatttggtttatccagccatgggagagct

SEQ ID NO: 35110 - DNA, 380 bp, Homo sapiens
  misc_feature 87: r=a or g
  misc_feature 92: r=a or g
  misc_feature 94: r=a or g
  misc_feature 98: v=a or c or g
  misc_feature 99: y=c or t
  misc_feature 103: h=a or c or t
  misc_feature 105: k=g or t
  misc_feature 329: d=a or g or t
  misc_feature 351: w=a or t
gtttccttctacagcatgtcagcatctcaagttcatttttcaacctacagtataacaatttgtaataaagcctccaggagctcatgrcgtgrargcavytgthckgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataatdactgtaccctcgcatgactgtwacagctttctgtgcagagatgactgtcca

SEQ ID NO: 35111 - DNA, 116 bp, Homo sapiens
agggtgagtctcttgatattcaggaaatcatcgcgcacccagtcaccagcgttcgggagcctgtcgcagcgggaccgacggaatccggagcaggcgacagggcgcagaagcgggat

SEQ ID NO: 35112 - DNA, 118 bp, Homo sapiens
ggggcgctcgtgggaaacgctcgcgggagagttggggaggaattgagactgggagcagagggacaagaagagtggagcagagagtgcttggcgggcgggtgcccgaagcctgaggaaa

SEQ ID NO: 35113 - DNA, 91 bp, Homo sapiens
  misc_feature 36: b=c or g or t
  misc_feature 41: n=a, g, c or t
  misc_feature 42: m=a or c
aaacacactaaaactcccacagaaagggggaaaatbagaanmggggtgatataatttgactctatgtcaccacccaaatctcatcttgaat

SEQ ID NO: 35114 - DNA, 174 bp, Homo sapiens
cttccattctttctgtttgaaggggtaaccattattcttctctctcaagaaatttttcttgcccttttgctatggatttcgaccccctgaccaaggctctttaggatgttacttgggtaacactcttttcactttgttttatttcttcaaatcagaaaacttgcttaagccaac

SEQ ID NO: 35115 - DNA, 363 bp, Homo sapiens
  misc_feature 100: y=c or t
ctgacatttggttttgtgtctgctaaaatcactaataagcttgtggttgcacacatgacgaaaagtgaaatgcatttgcatgacacagcattcataggtycggcacttttgtttctggaccagtattttaacagctttattgatgaatatattgtactttggattgccctggttttctctttctttgatttgatccgctactgtgtcagtgtttgcaatcagattgcatctcacctgcacatacatgtcttcagaatcaaggtctctacatctcattctaatcatcattaatgatgtaattggtatataggaacatcatgttttctgcaggaaagaaagtaacatattaaggagaatggggaa

SEQ ID NO: 35116 - DNA, 192 bp, Homo sapiens
tccattactgactttcttctacatcttacataaaattgttaatttccttactatacttataaccttacacttagagctcagggtagacccaaggaacgattgttaacttaggtcagacctgagcaccgtgggacctgcccaacctctctctcaccttgccaaatgcctcccactttcatagtatccccatca

SEQ ID NO: 35117 - DNA, 383 bp, Homo sapiens
  misc_feature 202: k=g or t
  misc_feature 203: y=c or t
  misc_feature 204: v=a or c or g
  misc_feature 239: h=a or c or t
  misc_feature 296: r=a or g
  misc_feature 317: k=g or t
  misc_feature 324: h=a or c or t
  misc_feature 339: v=a or c or g
agactcaggaggcgtctctccgagggtgtgggctgtgatggggccctgtgcacccatccaggctgcccagaccaggagagcacaggtcagccggacacatgatggtgcatacaatggaataggattaatccgtgaaaaggaagaaattctgacacatgctccggcgtggaggaaccttgaggacgacgctgagtgaaagaakyvagacacgaaaggacagatacggcaagactcgacthatgtgaggtccctagaggagtcggattcatagagactgaaaggatggcgggcaccargggcggtggagaggggaaatkgggagthactgtttaatggggvcagagtttcagttttacaagatgaaaagggtcctggagctggat

SEQ ID NO: 35118 - DNA, 289 bp, Homo sapiens
tttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaagaggcg

SEQ ID NO: 35119 - DNA, 407 bp, Homo sapiens
agacagacccacagctagaggcagagaatgggacacagaaaaaggagacaaagaaaccatggtgtctcagactcctgcccctgccacgagaacacaccctttccagtttgctggagaaatataagagaagtccagtgaaagagagctgagtttccccaatgatgccatcaagatgaactaactacagttaaccagccagctgatagcagatgcatgagtgagcccagctgagagcagctttttcagatcaaaggatctgtcatctggccattcatgatttaggatctccaaaggtatacctgttccaaaatgcgactcagaagtagtaagactttctgtggcttaacagtggggacacaaagaggcattcccagaaagggtgcagaacatacagcccctggaatcta

SEQ ID NO: 35120 - DNA, 308 bp, Homo sapiens
atataatctgaggccaggtgcggtggctcactcctgtaatcccagcactttgggagtccaaggtgggtggatcacctgaggtcaggagttcaagaccagccttaccaacatggtgaaaccctgtctctactaaaaatacaaaattagccggccgtggtagcacatgcctgtaatcccagctacttgggaggctgaggcaggagaattgcttgaacccaggaggcggagactgcagtgagccgagattgcaccattgcactccagcctgggcaacaagagcgaaactctggggtctcaaaaaaaaaaaa

SEQ ID NO: 35121 - DNA, 408 bp, Homo sapiens
taccacacctgattagtttttatatttttagtagagattgggttttaccatattggccaggctggtctcaaactcctgaccgcagtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctga

SEQ ID NO: 35122 - DNA, 291 bp, Homo sapiens
  misc_feature 59: s=g or c
  misc_feature 92: y=c or t
agaataagagattgtagactcaataaacgtcatttttttcagtgagattattggaaaasatgtgtgaatttagccacttttatgggtatttytattgtggtaagcatgtatgtattatgtattttctcacgtttcttactaaaggcctactgaaaatgttttaataaacatgtgccatctggtattttttaagaagtgtgtaatagttcaaaatctagcaaaactcaactgcaaagatttttaatatctgttgtagagctcaaggggttaacactatttgtgtgcggacac

SEQ ID NO: 35123 - DNA, 305 bp, Homo sapiens
agagatttcattcaatggcaacctcctccttcattccggggctctcctccaacctcaccagccccggtgctcctgtcttcatgggttgaaaaaggaccccgttggcacagccccacaagccctccctcctggcagttggagggataagagctgagttgggctggggattattgagccagcatgcaccaatgtgccccgatctgattgaaacattaggctgtcaaggccttgaatccttgcctcttttcaacgctctttctctgttgaagatgagcagccgtcaacactatcaccaaaaaaaaagc

SEQ ID NO: 35124 - DNA, 336 bp, Homo sapiens
  misc_feature 240: y=c or t
  misc_feature 241: m=a or c
ggtatttggatctatgaggcttctgtgtatggtcctttaggaatacttaggtatcttaggaagataaaagataccttctattcggccaggtggtcacaattttaaaccttcctcctgctgctagcttgtagctttctagttatcagacctgccttttatagaaatgtgctactgtatgtgttaaggaccataaaacagtggctatccctgtgtgttctgtctcctggatgccaaggtaaymgaaaggtccttaattgtaaatatgcccagggcatgtggtaatgctcctattttaagtctataattgaaatggaaattgcagcctttgtttattaa

SEQ ID NO: 35125 - DNA, 244 bp, Homo sapiens
agagacatcagaatcagaatataccttctttaccattaatgacatggctacagctctgaaatcaaagacctcatgttgacagctttttgagagatatttgcggggaggggttgagtaggattttaaatttagtaaactattttgtgcaaataagacttggtttcctttgtcttaccttaaagtggtgtgagacttcttttcatttcaaggaagggttatatttttacatttgtgcaccggccga

SEQ ID NO: 35126 - DNA, 96 bp, Homo sapiens
catcctaactatccagaagcgcactctcaggccattgtgctctgagattcccttgtgctctggcaccattatggtacatctctacgtcacattaat

SEQ ID NO: 35127 - DNA, 272 bp, Homo sapiens
  misc_feature 37: m=a or c
  misc_feature 106: r=a or g
tagtatgtttctgtttttcctatgaaccttgaaaggmgatttccttctactgttttgtttgtttgtttgtttgttttctatagggaaaaaacattcaagctcaaaratagaacagtcatctactgggtagttattacctgatttattagctcatgggtcccaaaacttttctatgcatgattcccccacctctttgaacaaggagggcttaaatacttgcaccattacaaaatggcaatcttaaccctgaactacttgctccacgctggccc

SEQ ID NO: 35128 - DNA, 171 bp, Homo sapiens
  misc_feature 19: m=a or c
  misc_feature 92: s=g or c
  misc_feature 93: s=g or c
agtgcgttacttacctcgmctcttagcttgtcggggccggtaaccgggcacccggtgtctgctcctgtcgccttcgcctcctaatccctagssactatgcgtgagtgcatctccatccacgttggccaggctggtgtccagattggcaatgcctgctgggagctctactgc

SEQ ID NO: 35129 - DNA, 163 bp, Homo sapiens
  misc_feature 117: k=g or t
aagatggccgaatatgaacagctcctgtctacagctcccagcgtgagcaacgaagaagacgggtgatttcagcatttccatctgagttaaaatcctggatatggagtccgagatatkgaaggccaattggctgccaaagaaatgggagagacaacacgtgcgg

SEQ ID NO: 35130 - DNA, 336 bp, Homo sapiens
tgtgtttctgagatcagactcctatatgggtttggatcagattaaaccattgaagttggaagttcatgaggctaagcctgtgccagaaaatcacccacagtgggatacagcaatagaggggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcat

SEQ ID NO: 35131 - DNA, 251 bp, Homo sapiens
  misc_feature 100: k=g or t
  misc_feature 105: h=a or c or t
aagtaagtagcagtgagcgattgtgaatgtgtaatgtaaatggaaaaccgggttttaccgtgttaagttattcactagggagccagtcgtagttctttgkaatchtctttcttccaaacctgctttgctgaaagttgcagaaaaggaagtgtgtggagagaaacagaacccttcagggtgggtcagaggacgccatccacagtggattcgtgttcgtttgcaggtggaagcagtgatttttaggacccgtt

SEQ ID NO: 35132 - DNA, 194 bp, Homo sapiens
  misc_feature 75: w=a or t
  misc_feature 88: r=a or g
  misc_feature 105: m=a or c
  misc_feature 168: m=a or c
cacttagtgaaaacccacaggccctgttggaggcatggagggtgagaaggaccagacaaacctggtccctctggwgtctccattctaragggaagggcacgggcmaggacatacaccaattaaagattgcatccatgtcaccaagggccggtggcagccatgtgagtmctggcagggggtttcgacaagagaga

SEQ ID NO: 35133 - DNA, 228 bp, Homo sapiens
  misc_feature 61: w=a or t
  misc_feature 84: m=a or c
  misc_feature 89: y=c or t
  misc_feature 122: k=g or t
cttcattccagtctgttctgcacactttgatcaggagaagcttctcacattccagccatgwtcatgttttctctcttgctcaamaaccyggcaatagcttcccattgctgaaaatctaaatktagcttttagtcagaactttccacttaaagttcttacccctggctatatattcaaatatctagggagcaatttaaaaaatactgatgcctgtgttctacccccgca

SEQ ID NO: 35134 - DNA, 232 bp, Homo sapiens
  misc_feature 98: r=a or g
  misc_feature 102: k=g or t
  misc_feature 104: v=a or c or g
  misc_feature 108: m=a or c
  misc_feature 120: k=g or t
  misc_feature 126: r=a or g
  misc_feature 155: k=g or t
taatttgatacctctttctcccagatgaattgtaactctaatgaggacagagattatatctgtatttatcataaatatatacttagtgcttaacgtgrtacktvgcamatagcagatgckcagacratcagttttaatgcaaaaggaaacccatktaccctcttgatggctgtggtgcatgtgctactgcagcttcttgaagattaagttgactcctaagagccatgaatga

SEQ ID NO: 35135 - DNA, 173 bp, Homo sapiens
  misc_feature 100: s=g or c
  misc_feature 102: m=a or c
  misc_feature 112: s=g or c
  misc_feature 119: k=g or t
  misc_feature 132: m=a or c
caatatctccgtgttttgtatatacaaccgctcttgtagcctttggtttttgttaatgtagagaaacacagattctttatacactttgtaagatttacgscmaaaccccagstctcgakctcttcttctccmtgtggcccctgcgctgttgccccgtccccgtcaccccgccg

SEQ ID NO: 35136 - DNA, 68 bp, Homo sapiens
  misc_feature 2: n=a, g, c or t
  misc_feature 3: d=a or g or t
  misc_feature 23: k=g or t
andcattcctttccttcctagckttggtcgtcgccgccaccatgaacaagaagaagaaaccgttccta

SEQ ID NO: 35137 - DNA, 232 bp, Homo sapiens
cccaaactggaaacagttcatatgtatcaagaggttaatggaccttttgtgatatattcatccaatggaataccaccctcagtaaagatgggacaaattatggaaacatgagataacatgggtgaatctcaaaagagtgcattctgtgtggtgccatcaaggtgaatttctggaacaggtgaaactaacctgtatagtggcagaaaatacatcattaattgctggggcgcta

SEQ ID NO: 35138 - DNA, 219 bp, Homo sapiens
  misc_feature 9: v=a or c or g
  misc_feature 73: m=a or c
  misc_feature 83: y=c or t
  misc_feature 85: w=a or t
  misc_feature 87: d=a or g or t
  misc_feature 88: y=c or t
  misc_feature 96: w=a or t
  misc_feature 105: m=a or c
  misc_feature 126: v=a or c or g
gcctttgcvatctccacgttgcgatggatccttggacccacttttgttaactcttaaactttgtgtctttgtmtttatttctytwcdyattccccwcgtctccamccgggaaggggagagcctgcvggtggtgtatcaggcaggttcccctacatctttggcacccaacacggtctcctcgaacccaggtgaagttacacctgagcgtggtcgttgtga

SEQ ID NO: 35139 - DNA, 380 bp, Homo sapiens
  misc_feature 2: k=g or t
  misc_feature 63: w=a or t
  misc_feature 307: w=a or t
  misc_feature 317: w=a or t
  misc_feature 318: r=a or g
  misc_feature 331: w=a or t
  misc_feature 332: w=a or t
akagggatgcagccactaccaaccaaagtatggcagagaagtagcagagaagaaataaaagawatcccctctcactctccaattctgttgttgcctccatgcgccaatccaaaccgaaagccagaaggcaaaactacctggtgtgtctggaagtgtctgtttctggaattccactcacaggggaaaattagcctgaaccagatggcttgaaacagtcctcatgggtgaggggtggaaggagacactggaaaaggggactgaaatcagctttaggaactttctgtcctttaatctcaagaatacagawagtgaatgtwrcatgttatgagawwcctcatattgcctgtagatcttcactttcaatacacacacacgcacac

SEQ ID NO: 35140 - DNA, 311 bp, Homo sapiens
  misc_feature 44: w=a or t
  misc_feature 212: k=g or t
  misc_feature 272: n=a, g, c or t
accgagaaaaggagcaactcagctctttgcaagaggagctagawtcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttktcagcaaatttatattgttttgctaggtgttcatcctataagaagcaggattgtataggnagaaaaatgattgtaggaaagttgcaggattagcggaat

SEQ ID NO: 35141 - DNA, 78 bp, Homo sapiens
  misc_feature 14: r=a or g
  misc_feature 18: w=a or t
  misc_feature 26: r=a or g
  misc_feature 31: w=a or t
  misc_feature 47: r=a or g
  misc_feature 52: w=a or t
agtagacaagtaarggcwtgaaaatratacwggcaagatacgcattrgctcwagatctacattcttcaaaaaaaaaaa

SEQ ID NO: 35142 - DNA, 262 bp, Homo sapiens
ttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagcta

SEQ ID NO: 35143 - DNA, 300 bp, Homo sapiens
  misc_feature 46: s=g or c
  misc_feature 76: h=a or c or t
  misc_feature 105: r=a or g
  misc_feature 119: s=g or c
  misc_feature 135: m=a or c
  misc_feature 147: s=g or c
  misc_feature 161: s=g or c
  misc_feature 237: b=c or g or t
  misc_feature 249: m=a or c
gagacatcgaggagaggagtaagaagcatcggaggaggcgatcgasgaggaggcggtgtgtgtgtatgtgtctathctacggtgtggctcgtcgtggggcgagargaggctcgagagasggcgagggagaagcgmaaagagtaagasagtcttcctttgcsagagcctctaatctggtgagggtcccgggccggccggggcgctaggagagagggaggaggccggggggcgtgtctbggatcgggctgmgagatgaatgggccagggatgaatggagggaggcagcggcggccaagagtc

SEQ ID NO: 35144 - DNA, 209 bp, Homo sapiens
  misc_feature 27: y=c or t
cacataaagtcagaagggaggaaaggygcacgcgcattggggacttgactctggaaagcgtccagaccaaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaag

SEQ ID NO: 35145 - DNA, 218 bp, Homo sapiens
  misc_feature 34: y=c or t
  misc_feature 44: w=a or t
  misc_feature 48: w=a or t
  misc_feature 71: w=a or t
  misc_feature 76: r=a or g
  misc_feature 95: y=c or t
  misc_feature 105: w=a or t
  misc_feature 110: r=a or g
  misc_feature 178: m=a or c
actttgctgtgctgtacttttacacattcttttyaactatagcwtccwgctttgctctggatcaggaagcwattgragctgacacccacagagtyaaactcagtwgctgragccaccagctccccctcccagtccttcttttcagagtaggctggcagctgtcctaactgcctactamagccaaatgcttgaggagagagagagagtaaggaaccgcc

SEQ ID NO: 35146 - DNA, 67 bp, Homo sapiens
  misc_feature 10: w=a or t
  misc_feature 12: r=a or g
  misc_feature 35: d=a or g or t
aatgaaaggwaraatatttcaacccggctgtcggdctaaaagaggagagaatgctttctttaaaaaa

SEQ ID NO: 35147 - DNA, 294 bp, Homo sapiens
  misc_feature 89: w=a or t
  misc_feature 107: s=g or c
  misc_feature 180: b=c or g or t
  misc_feature 194: w=a or t
  misc_feature 204: v=a or c or g
  misc_feature 205: m=a or c
  misc_feature 241: v=a or c or g
  misc_feature 266: k=g or t
  misc_feature 271: k=g or t
ttcaaaataatatcactgcccaaatgtcccattaagccaagcattttatgaatcagcaagaccagtctcctctccctgctgtcatttcwtttgtccttccccttttstccctcctgccaagtacttgcatatctgtgtgcttatgttagcagcatccacactgatacctgttctcttttbttttcaccctagcwccaggggtavmaggagagactgaaaaaaaaatattctggaagtcttvgatatgggataaaattcaaggaaakgattkcttatcatcttgtcacctttaaa

SEQ ID NO: 35148 - DNA, 240 bp, Homo sapiens
  misc_feature 20: s=g or c
  misc_feature 103: v=a or c or g
  misc_feature 216: w=a or t
agcacggcgacgccagcggsggaagggaaaaggccgaggcatcagcgtgtgaagaccgcaaagacgatcccgagtacagttgtgaacagcattgctgctaggvtcctcctgcagatcatctgaaatgaacctctcttattgatttttattggcctagagccaggagtactgcattcagttgactttcagggtaaaaagaaaacagtcctggttgtwgtcatcataaacatatggaccagt

SEQ ID NO: 35149 - DNA, 288 bp, Homo sapiens
  misc_feature 85: r=a or g
  misc_feature 89: k=g or t
  misc_feature 97: k=g or t
atcagtcaaagttagttcttagtgatcatatggtcagctaatattagttcttagtgatcagtggtcagtaatcttcaaagtcagratckatcacctkggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatttg

SEQ ID NO: 35150 - DNA, 185 bp, Homo sapiens
  misc_feature 84: r=a or g
atcagtaactcaggctgtttcccacactacaggccagcactgtgggctctcagtttattgggaaatggaaataagagggaaggrcaaaagtccactgggaagcagactggacagaaaggaactctgagcagctaaactctgactaatcccagggtatacctgcgttttctcttcaccagatcaat

SEQ ID NO: 35151 - DNA, 67 bp, Homo sapiens
  misc_feature 49: k=g or t
aagcgtttcctgagttcgggggtcggcggaagatggcggccggcgaaakgagctggtgcctgtgcaa

SEQ ID NO: 35152 - DNA, 125 bp, Homo sapiens
atacatcaggtgagttatgttcatttcaaaacagagacattaaaaatgtgtcttcttcttgcccaggcaaaaatcccacaagggtaagaaagaggcacgtggcctggattcttcatcccatctcc

SEQ ID NO: 35153 - DNA, 193 bp, Homo sapiens
tcatgtcaggagttacatgctatcagcttgatggtgtattaactttggacacttggttaaggtagtgtgtgttggttttttgctgctgaaaattactgttattttccctttccatacttctgttctttggaaaacagtcactaagtccagtcatgggaggtggtgggtgggaaagattacattcaacccccac

SEQ ID NO: 35154 - DNA, 133 bp, Homo sapiens
  misc_feature 60: k=g or t
cctgcgcttgcgtggtggatccaacaccagccctgcgtcgtgggacttgcctcagatcakcctgcgactgcaagattcttactgcagtagagaactctttttctcccttgtacttttttttgacctgtcatct

SEQ ID NO: 35155 - DNA, 336 bp, Homo sapiens
gtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctt

SEQ ID NO: 35156 - DNA, 348 bp, Homo sapiens
  misc_feature 71: h=a or c or t
  misc_feature 72: s=g or c
  misc_feature 163: n=a, g, c or t
  misc_feature 164: n=a, g, c or t
  misc_feature 322: y=c or t
cacaacatatttgtcacctgatcagtacataaccttgttttattatgtgtttctttttaaagacaccttahsttattttttttaatttttgctacggagtcttgctctgttgcccaggctggtgtgcaacagcgcgatctcggctcacagcaacctccacctnncaagttcaagcaattcttctgcctcagcctcccgagtagctggaattacaggcatgagccaccatgccctgctgatttttgtatttttagtagagatgaggtttcaccatgttggccaggctggtgttgaactcctgacctcaggtgatccgcctgcytcggccccccaaactgctgggataac

SEQ ID NO: 35157 - DNA, 171 bp, Homo sapiens
  misc_feature 95: s=g or c
atacaaaaaattagccgggcgcggtggcgggcgcctgtagtcccagctactcgggaggctgaggcaggagaatgtcgtgaacccgggaagcggasttgcagtgagccgagattgcgccactgcagtccgcagtccggcctgggcgacagagcgagactccgtctcaaaaaa

SEQ ID NO: 35158 - DNA, 302 bp, Homo sapiens
  misc_feature 138: v=a or c or g
tgttttctttggcctgggtggtttataccctgagccaacctttaaaaattggtagatttcacataaaagtccagatccacagcttctcttgaagaatgaccacctggctacgccggctcttcggtggcaacactactvgggacactgcctccccagtcaccaagggccccagctggcccgttctactcacctaagtgccgcctgacccttgtacactaggaggctggcctcccacctctgcagggttatttcctgcacctcgaggccgctgcgggccaatctggagtgaaacacgaggaccc

SEQ ID NO: 35159 - DNA, 232 bp, Homo sapiens
caaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcctc

SEQ ID NO: 35160 - DNA, 194 bp, Homo sapiens
tcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacaccc

SEQ ID NO: 35161 - DNA, 423 bp, Homo sapiens
  misc_feature 95: w=a or t
  misc_feature 97: s=g or c
  misc_feature 366: h=a or c or t
caaggcagagcttctgaatttcaggccttcattccagagccctcttgtggccaggccttcctttgctggaggaaggtacacagggtgaagctgawgstgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacachtttgagccagacagcctggctgtcattgctttcttcctccccatttggaccttctct

SEQ ID NO: 35162 - DNA, 195 bp, Homo sapiens
  misc_feature 97: r=a or g
catctcagtaataaaaattaagctgtaatcaaccttctaggtttctcttgtcttaaaatgggtattcaaaaatggggatctgtggtgtatgtatggraaacacatactccttaatttacctgttgttggaaactggagaaatgattgtcgggcaaccgtttattttttattgtattttatttggttgagggaata

SEQ ID NO: 35163 - DNA, 54 bp, Homo sapiens
  misc_feature 2: k=g or t
  misc_feature 3: k=g or t
  misc_feature 6: k=g or t
  misc_feature 9: d=a or g or t
  misc_feature 31: k=g or t
gkktgkttdggttggggctctcggcaactckccgaggaggaggaggaggaggga

SEQ ID NO: 35164 - DNA, 230 bp, Homo sapiens
  misc_feature 205: k=g or t
  misc_feature 206: h=a or c or t
  misc_feature 212: y=c or t
  misc_feature 214: k=g or t
ttttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttkhtttttyckctcaacaccatgaaac

SEQ ID NO: 35165 - DNA, 366 bp, Homo sapiens
  misc_feature 75: s=g or c
  misc_feature 76: s=g or c
  misc_feature 117: n=a, g, c or t
  misc_feature 142: y=c or t
  misc_feature 144: n=a, g, c or t
  misc_feature 145: k=g or t
  misc_feature 274: s=g or c
acttgatcgatggcttcgccatcgccagcttcgccaccctcgaggccttgcagaaggatgcatctcttcagcccssagagcgactggaacatcggctgaagcattctgggaagcggnaaagggggggctccagtggggccaycnkggagccaggggacagctctgatcgagagcctggccggccccctggggatcgggcccgaaaatggcccaataagcggagaagaaaagaggcgtcctcccgtcactctctggaagctggatacatatgtgscgcggaaagtgatctggacgagagggtctccgatgatgacctcgacccatcctttactgtctcaaccagcaaagcctcgggcccccacggcc

SEQ ID NO: 35166 - DNA, 226 bp, Homo sapiens
cactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcctccagcctctggcctccctccagtagccccacat

SEQ ID NO: 35167 - DNA, 219 bp, Homo sapiens
  misc_feature 42: m=a or c
  misc_feature 60: b=c or g or t
  misc_feature 166: m=a or c
tagtatgtgtttttgatacgacaccttagaattccagtaagmaaataaacaatgaaaatbatgttttctagggcaacgctaagtgtcctgtttctaagttgttgtgagaacgcaggtaaccaaggatattagaaatagatctaaaataagataggcatcttattgmgacctgtttttggtctggtcacagatttgtccttgtttaatttttacctagaa

SEQ ID NO: 35168 - DNA, 206 bp, Homo sapiens
  misc_feature 175: k=g or t
catatcagatcactccaagatcacaaaatctatcatggccggtgcagtagctcacaccagtaatcccagcattttgggaggccgaagtgggaagactgcttgagcccaggagtttgagaccagcctgggcaacaagatgagacccccatctctacaaaaaataaaatagccagtkgtggtggtacagtctgtatttgggaggccgc

SEQ ID NO: 35169 - DNA, 184 bp, Homo sapiens
agcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagaa

SEQ ID NO: 35170 - DNA, 74 bp, Homo sapiens
  misc_feature 2: k=g or t
  misc_feature 5: k=g or t
  misc_feature 33: k=g or t
  misc_feature 47: r=a or g
tkgtkaggaacatttgagttacttcaatcattktcacaggcagccarcaagcaattaagagcagttataataga

SEQ ID NO: 35171 - DNA, 72 bp, Homo sapiens
  misc_feature 40: r=a or g
agtgtgtgtatatacacaacatcaagagcaggaaaatggrctcattagggaggcaggcagtcattaccactc

SEQ ID NO: 35172 - DNA, 69 bp, Homo sapiens
gtcactgatgaaggtctcgtagcgcacactttctcccccgtggcctccaccgcccgccgcttagggggc

SEQ ID NO: 35173 - DNA, 70 bp, Homo sapiens
gctattcttttctggtgtcggggagctgaatattaaaagggtgattgtggagttaccggttatctgcatt

SEQ ID NO: 35174 - DNA, 150 bp, Homo sapiens
  misc_feature 20: b=c or g or t
  misc_feature 27: r=a or g
  misc_feature 40: k=g or t
  misc_feature 47: k=g or t
  misc_feature 51: y=c or t
  misc_feature 53: b=c or g or t
  misc_feature 68: k=g or t
  misc_feature 100: k=g or t
  misc_feature 104: k=g or t
  misc_feature 107: r=a or g
  misc_feature 117: m=a or c
  misc_feature 124: k=g or t
cccttctccccggcggttabtgctgaragtgcggagtgtktgctcckggcycbgaacacacatttatkattagaaaaatccaaaaaaaatctaaaaaaakcttktaraaaaccccamaaaaatktacaaaaaatccgcgtctcccccgcc

SEQ ID NO: 35175 - DNA, 184 bp, Homo sapiens
ttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgcc

SEQ ID NO: 35176 - DNA, 148 bp, Homo sapiens
  misc_feature 9: m=a or c
  misc_feature 10: y=c or t
  misc_feature 27: b=c or g or t
  misc_feature 34: y=c or t
ccaaatctmyctgattggtgtacctgbaaagtgyatggggagaatggaaccaagttggaaaacactctgcaggatattatccaggagaaacttctccaatctagcaaggcaggccaacgttcagattcaggaaatacacagaacgccc

SEQ ID NO: 35177 - DNA, 262 bp, Homo sapiens
  misc_feature 10: n=a, g, c or t
cttgatcatntataaattttatgtgctttgttctatttatttttatttttaaattttttggtagagacagggtctcactatcttgaccaggcttgtcttgaactcctggccttaagtaatcctactgcgtggcctcccaaagtgctgggattacaagtgcgaaccactgcagtcagcccactcttttatttcactgttttgtattctgttcctgattgtgtattcatgtataaatatcttgctgctttaattacagagtaca

SEQ ID NO: 35178 - DNA, 120 bp, Homo sapiens
  misc_feature 2: k=g or t
  misc_feature 6: k=g or t
  misc_feature 77: k=g or t
  misc_feature 117: v=a or c or g
tktttktttgattatatgtgattttggtgttttttagtgagcatcattactcctgaatgtagttactgattcttttktcagatgtttgaaataccagtggaattgtaaatgggcaavagt

SEQ ID NO: 35179 - DNA, 134 bp, Homo sapiens
  misc_feature 85: s=g or c
  misc_feature 93: m=a or c
  misc_feature 117: y=c or t
aaacgggcgtctggatccccgaatggttgcgtgtttccgtgtgtgggtccgggggaggcccacgaacgccagcgaaaccgctgasaccaccgmccaactatgaactcatcaggcgcytgaagaccgacacgccg

SEQ ID NO: 35180 - DNA, 408 bp, Homo sapiens
  misc_feature 247: s=g or c
gcgggtaacaggtgtttttagggactgtgtttacattatccggtgtgcatcattctcaggatctagatacctaagtgatagaattagtaatcagagcttcattgggtgagcagggaatcacaaggaaagggaatttacttcaaagggataatggaaagtcttaccaaactggcatcccactgcaaagaatacctttctagtgatttgagtattgattacatactgtgaaacccaatgtctccttacstttcatggtactgggtaaactctgacaaataattgctctttagataacccatttctgaatttttttgtaatctggtagttgtctttttctatccccaagcacttgaggatgtgccaaactccaccagacacagtgattcattgacacagagattctcaact

SEQ ID NO: 35181 - DNA, 201 bp, Homo sapiens
attcctgcactctgcgccctagcaccatgcattttcgtgaatcactccctggtttggggtactggtgtgtatgtgtatgcgcatgtgcgtatatgcgcatatgaatggagagtaaatttgaatttttgctgggcacacggcgcagtgaagacaagaaaggggcactattttaacacaaccttttcccgtgatcaccaccga

SEQ ID NO: 35182 - DNA, 75 bp, Homo sapiens
ataataattctcctttacaacgttagggctgaataaaagatagaatccttatgaaatagtgagcccaatgtcatt

SEQ ID NO: 35183 - DNA, 276 bp, Homo sapiens
  misc_feature 87: r=a or g
  misc_feature 101: d=a or g or t
  misc_feature 102: n=a, g, c or t
  misc_feature 104: r=a or g
  misc_feature 105: w=a or t
ttacaatacggacttctgtgtatatgttatactgattctactctgcttttatcctttggagcctgggagactccccaaaaaggtaartgctatcaagagtdngrwctttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagccg

SEQ ID NO: 35184 - DNA, 56 bp, Homo sapiens
actgaaagggaggacgggagaggagtgtgtgtgtgtgtgtgtgtgtgtgtgtgtgt

SEQ ID NO: 35185 - DNA, 440 bp, Homo sapiens
atatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggct

SEQ ID NO: 35186 - DNA, 112 bp, Homo sapiens
agtagagacatggtttcaccatgttggccaggatggtcttggatctcttgaccttgtgatccgtccaccttggcctcccaaagtgttaggattattggcgtgagcaccgcgc

SEQ ID NO: 35187 - DNA, 275 bp, Homo sapiens
  misc_feature 221: r=a or g
  misc_feature 222: s=g or c
  misc_feature 224: n=a, g, c or t
  misc_feature 248: w=a or t
  misc_feature 249: k=g or t
cccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacarscnagaaatttagacagggatctcttwkcctttggaaaataggggttaggcccc

SEQ ID NO: 35188 - DNA, 278 bp, Homo sapiens
  misc_feature 88: s=g or c
  misc_feature 191: h=a or c or t
  misc_feature 227: h=a or c or t
  misc_feature 240: m=a or c
  misc_feature 254: r=a or g
  misc_feature 264: s=g or c
gaaaacaaacaagctgggagaagcaggaatctgcgctcgggttccgcagatgcagaggttgaggtggctgcgggactggaagtcatcsgggcagaggtctcacagcagccatacgcctgcctcacaccttgcgatgcgccaacatcaccatcattgagcaccagaagtgtgagaacgcctaccccggcaahatcacagacaccatggtgtgtgccagcgtgcaggghagggggcaaggamtcctgccagggtgrctccgggggscctctggtctgtaa

SEQ ID NO: 35189 - DNA, 284 bp, Homo sapiens
  misc_feature 275: y=c or t
cggtgagcggcagtagccggttatgacgactccctcctctggaacagccgccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagcyacccccgct

SEQ ID NO: 35190 - DNA, 306 bp, Homo sapiens
  misc_feature 18: m=a or c
  misc_feature 120: v=a or c or g
  misc_feature 126: r=a or g
  misc_feature 247: r=a or g
ccatttaattcttaaacmtatggcctttttattgagcacactcttaaatcattatttggcttgtaaacattcatctgaattgtggctacaatcctctttaaataatctaggaaaaaagavagataragcttacattttcacagttttggctcttaaacacattccacaaatgccattaagaatttattttgttttaggccagtcatggtggctcatgcctgtaatcccagcaatttgggaggctgargcaagaactgcttgagcccaaggagtttgagactagcctgggcaacatggcaagaccct

SEQ ID NO: 35191 - DNA, 241 bp, Homo sapiens
acttagatgtggttgtggagatgttttgcttcttgtacttccctggttcaggtggcttccctggaaatactgcatctgcctttaaagttcattaactgtgtttcttgtgtacatggcagtagatgagattagggattgaagtcactttaagtccaagaaaagtattgaagatatgtgttgaaggcattaccaagatgaaatatttattcatatcattaacttatttgttcaaagaaacgcc

SEQ ID NO: 35192 - DNA, 326 bp, Homo sapiens
  misc_feature 276: y=c or t
  misc_feature 277: k=g or t
acacttagtacctcataatatctacccatttaatccccaaagcaaccccatgaaatagatacttttaatacctcctagtctacaattgtggaaacttttataaagacacaaagcttaaacaacttttcccaaaattatattaatggccactaatgtggaggagtgatttgcacctaagccaactgtcttggaagtccacattcttagctgaaagggaaatctgcgtttagtaaaggtatgagatggagctaagtttcttcatctgtattctgtaayktggtcattataataataaacattataggattctcagttctcaaaaacta

SEQ ID NO: 35193 - DNA, 418 bp, Homo sapiens
ctcctagcatacacaaactatccttgtcacctttattttaactgaatatggtctagggataaattgaagtgggttatgaaaagaatgtttatttgagatttcattttaaatacttgttaagtgggggagttctcttttgacaatggcagactatgttattttgaaccaactctcccactaaaaacaactagaaaatatggagaaaatatgaaaaatcttctgcttaaaggcataagaaagttattaaggtagtaagaaatcactggatcaagatccaggagaggaaaggtccaaaagcagtggttgagaggctcagaaactgagcatagcttttagtacaataatggggctgatggaggatcataatggggctaggtattattcaaaaaagatacttgcacactcatgtttatagcgc

SEQ ID NO: 35194 - DNA, 177 bp, Homo sapiens
ccattggtataactggcaaataaatctcaatgtcaaatttaaagagaagagaaactcgctttatgtggcagatttcactgcctcttacttgttcaagaatagggatgcctgtctttggtacagtccatcaacttaaacactgccaattaccaacgccttcctggcattcaaggccct

SEQ ID NO: 35195 - DNA, 197 bp, Homo sapiens
ttttcttttaaaaataaaatccttccttcccatgttactaaattaatttatgtttttgagaggttgagtctcaaagtgtaaacaataaaccctccattcataaggtggatgttgtaagcttgatggtggttgtgaaagtgatttagctttgaccacttttcatcctacagcttcaatatcaaactggttaggaaagc

SEQ ID NO: 35196 - DNA, 240 bp, Homo sapiens
tcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagc

SEQ ID NO: 35197 - DNA, 355 bp, Homo sapiens
actacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctct

SEQ ID NO: 35198 - DNA, 178 bp, Homo sapiens
aagatagctggggagaggtagagggtggcataagaatgggaaccagaataagagtgagtataaaagtaaagaatgggacttcatcagggtgaaagtattggagtgtactttgtcaatgaagatcttctatccacttaaacagagacttaagggtggcagtttgaggtaaaaccaggca

SEQ ID NO: 35199 - DNA, 272 bp, Homo sapiens
  misc_feature 145: k=g or t
  misc_feature 161: r=a or g
  misc_feature 162: k=g or t
ctccagctctcctgcctgacgctgtgcacagcctgtggctattgatgcctgtaagagaccaccccctattgcaccccctttctgcctagttgacatctatgcatacttcagggaataccccaaggactggtcatgttcacctgtkctatgctgtcagtgcrkcttgtacttattcctcacagaacttttcagtcatagtcagtcctgtgagctttatgcaggaaggaatttggttggcttcctagcattttcaagatctctcatggcgcccc

SEQ ID NO: 35200 - DNA, 326 bp, Homo sapiens
tgggatcatttaaggcctcatctgttcagaaccaaggggaggaccgaaatagtatgccaaattcttttccagccctcaaattttatgagcctgagttgcattgtgtgggtaaaagtcttgtgctctgtggatcagaaggaagttagatcttttggatatttacatagaaacaaagaatttgaagactggaaagaacttgagcaggactctattaaatgtgttttgtgtgagatggttttcaccctgtgttcttgtggttcctccatgctaggggcaggaggtaggatggagcagatagggagtctcttttcctcttaaaccggcgt

SEQ ID NO: 35201 - DNA, 401 bp, Homo sapiens
agaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccc

SEQ ID NO: 35202 - DNA, 87 bp, Homo sapiens
  misc_feature 23: s=g or c
  misc_feature 24: s=g or c
  misc_feature 25: m=a or c
  misc_feature 43: s=g or c
acacaagatggcggcgcccagcssmgtaggggctgcgcttggsgtttgctgaagctggctgcctctcccactccccttttgggtgca

SEQ ID NO: 35203 - DNA, 269 bp, Homo sapiens
  misc_feature 95: k=g or t
tgttcattgttatctgagttatttcatttgtttgcttatttgtctgcccctgcacctctgtgagaacagggactgtagctgttttgttttctackgtgtatgcagtgcctagaaagatccctagatactctgtagatatctgttaaatgagttaaaacaggaaagccaaataatttttatgtatttgggcttgatgtaataattgttgtttacaaataaaaattagaaatacttgatcagttgtctttgtaaaccagagtagcacctca

SEQ ID NO: 35204 - DNA, 170 bp, Homo sapiens
gtagaagactggttctcaggctgatgcagaaatccaggaaagagctgatggtgaccaaagtggaggtgacagagctgggaatggaggagaacaggctagaagactgattgaggagttgaagctgtctttgaagagcaaagaagctttaattcagtgccttaaagaggagt

SEQ ID NO: 35205 - DNA, 172 bp, Homo sapiens
tgagcatttaatactgtattagtctgttctcacactgccaataaggacatacctgagactaggtaatttataaagaaaaataggtttaatggactcacagttccacatggctggggaggcggcacactcatggtggaaggtgaaagacatgtcttacatggcagcaggcccc

SEQ ID NO: 35206 - DNA, 396 bp, Homo sapiens
  misc_feature 273: d=a or g or t
caaaaataattagagacaaatgattaactttacagctgcctatggtaataggtaacagttgtggtgaacattaagctaaccaaaaagcttaaaagtaaatgctggggaatgagatgtccatatggagcttagaaaacctccaacaaatacctgggaatctaaaaggctatgcatatgcacaggatgataggcattcccaaggctgtgcacatgctcagaaaacacctaagaaaggccaaagttctcacctatggctgaacttcaagctctgtdcaagtgaagtgctaaggcaaagttgcccccaacatacacacagagcatcttggtaaagactgggagacttactggctccatgaatttaagcaattctctgtacaaatcattagctgacgagac

SEQ ID NO: 35207 - DNA, 103 bp, Homo sapiens
  misc_feature 43: s=g or c
aagaaagcttgtgggtgctaactggattgttaattcttttgcsgttggtctattggtggtgttgacgagaataatttgtgtgtgtgtgtgtgtgtgtgtgtgt

SEQ ID NO: 35208 - DNA, 371 bp, Homo sapiens
  misc_feature 93: r=a or g
catttcacttttgagcagtttcttacccgaggtagaaatgcaataaccatttcttggtaggtggtgtaggggatagacaggtaaatattaagrcacagttcatcatcccccaccttggcaaattacggacacagcccagtagggagtataagggttgtacacagctatcatgcgcttgatcagtgcatgtcttcaaagtggacttatacctcagcagagagctaagaagcatgaaggaagtcttcatggaggagatggcactggagctaagtcttcagagtcggcattttggcaggtggagattgggaaaccagaggaacttcactagatgcaaggtcctgttgaagattcaaggtaatgagacacataat

SEQ ID NO: 35209 - DNA, 284 bp, Homo sapiens
  misc_feature 133: v=a or c or g
  misc_feature 236: w=a or t
tatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcvtggggtttcctttggaaatgcactgttctcagcccagctgggttccaacgggggcacctgggacgacagaggcatctcggggcagggggcagaggccacgggwgggtcaggtgggacccttgacggcaccctctgatctcttggggggctt

SEQ ID NO: 35210 - DNA, 107 bp, Homo sapiens
gtttgttttgttttgtttttaatgagttttaattagaaatgccatcacaaagtgaagatgcctggccgcttggtcgactgtgcaatgtctgttaaccacttagcccc

SEQ ID NO: 35211 - DNA, 332 bp, Homo sapiens
  misc_feature 286: r=a or g
  misc_feature 287: r=a or g
ccaaaatgaggactattaaaaggactgcattcttcaaaaatattaatgtcacataagacaaggaaaagctgaataacttccaaattaaaagagactaaagcatcatgacaaccaaatacaatacaggatctttgactaggtcttgtgtgagagaaaatctcctaaagacattattggttcaatttttcaaaactggaatacaagcaacagaatagataaaagtaatgtattgatgttaaatttactgcagttgataactgtatcatggttgtgtaaagtattaatrrtatcctcattattgagaaatgcatattgaagtatttagaggtata

SEQ ID NO: 35212 - DNA, 250 bp, Homo sapiens
  misc_feature 79: n=a, g, c or t
tacacattttttctgggccaggcatcattctcagagttttaataactcattaatcctcacaacaaccctgagaagtagntactataatacccgttttacagatgaaaaaaacaagcacaaaaatgttaatgaattgtcaaagctttttcagccagtaaatggcaaaactgaaattcagattgaagttgtttggctctaaataagttggtattctctgccactgtgctgtagtgctctctgcacagttgct

SEQ ID NO: 35213 - DNA, 259 bp, Homo sapiens
ttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgcat

SEQ ID NO: 35214 - DNA, 236 bp, Homo sapiens
aaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatacgctaggacatgttaggcac

SEQ ID NO: 35215 - DNA, 435 bp, Homo sapiens
  misc_feature 258: d=a or g or t
cccttctcaagtttttatttaatgtgcttttaaaaggcaaaccccacataccatcagtttggttactcttcccattccctcagctaccaagttattttggttgaatagaagctttcctttttgtagggtgtcttcatttcttacatctcactctatttcactgttaggcacaagggaatggacacatttgacaagttccacagtactagatgggtcctctaagtacagtctgaccttcagtttcagctttcctatttdatctgtcatgtaaaattaattgtactccaaagtggccatcaaatacagtccctatttgactttttgttgttgttgagacggagtcttgctctgtcacccaggctggagtgcattggcgccatctcggctcactgcaacctccgcctcccgggttcaagcagttctctgcctcagcct

SEQ ID NO: 35216 - DNA, 139 bp, Homo sapiens
aaaagccggaagccgggtcttggcggcagtcgacaggatcgcctgacgcgggcacagcgtcctccaagaggccaccttgctgagaggcagacttcccatccacaaaatgggatattgattcctaataaacaccttgccc

SEQ ID NO: 35217 - DNA, 192 bp, Homo sapiens
  misc_feature 92: k=g or t
  misc_feature 125: k=g or t
  misc_feature 139: k=g or t
  misc_feature 164: k=g or t
ctagggtttatgttagggtattgatagattagagcaggtggttgaagagatcttctctggtcagacttggaagaatttccaaaactgaagtkagccccaagacttccctagggttgatgtacttkatgatccagatgckaaacttcttagaatgaaaatatgcktcaacacttaagtagcatacactgccca

SEQ ID NO: 35218 - DNA, 258 bp, Homo sapiens
  misc_feature 103: y=c or t
  misc_feature 110: w=a or t
  misc_feature 199: k=g or t
  misc_feature 203: w=a or t
  misc_feature 229: k=g or t
  misc_feature 230: y=c or t
agccatgtgggttcagcggaaagagaagcaaaaccactcttcctaaaatgttagaagctgctcttcgcttaccttggggcctttgcattgggagctgtttttyacatcawagaatatgtgctgaatggtattttagtattttgctgtcgttttattattttcgtctggtcttcctcagttcttccagacgctttctgakagawtgggggcaggagctctagccatctgkyaaagtaaagcagcggttcggctgataga

SEQ ID NO: 35219 - DNA, 323 bp, Homo sapiens
taaaagaagcagcaaatagaatttcccacaaagtaagttgactctaaatcttaagtattacctagttttttaaaggtttgaatataataatgcagtatttgcagtataaaaaggaaggaatttgtagagaatcattttggtgctcaagtctcttagcagtgccttattgcctcatagcaagaagatgctggggttttttttgtttttgtcctttgtattaatgtatgatggtttgcgcctttttggcattctttcaacatgtcgtgtacatcacaccatgaatcagttcctaattgatatatctagctttacctcccgagttc

SEQ ID NO: 35220 - DNA, 256 bp, Homo sapiens
ccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacac

SEQ ID NO: 35221 - DNA, 93 bp, Homo sapiens
aagcaggaagctgcggcttaaaagggcaacccgcgcgacccttcctccctagtcgcggggagtctgagaaagcgcgcctgtttcgcgcccatc

SEQ ID NO: 35222 - DNA, 375 bp, Homo sapiens
  misc_feature 268: n=a, g, c or t
  misc_feature 269: w=a or t
  misc_feature 277: h=a or c or t
  misc_feature 278: n=a, g, c or t
  misc_feature 279: b=c or g or t
  misc_feature 280: w=a or t
aatcaggtattatcacctctcctttttcagatgtcaccatcaacagtgtatgctctttaccatttgcatttcaagaaccacttggaaacttggaaataatcctttatttttgctagtcatgcctctgtcgtaatgttccaagaggcctgggctgctttggagaggcttgtctggctttgcctgccccctgcctcatttaactacaatagaatagctcataagatgctctctgcataagattttatttgaaggaaggtatctatatttnwcttgggahnbwaatagcttaggtagaattataaacgagatggtaatattgccaaataaatgggatacaccctgcccagctccttcccattctgtcacacagtgcat

SEQ ID NO: 35223 - DNA, 241 bp, Homo sapiens
  misc_feature 95: k=g or t
caaagctggaataatttgagcaacaaaaataatgtagtgaattataactcaaagtataaaataatcccacatatatgatataaaggatataagtkgacataaaggattgaataaatatgaggcaaaagagacaaatctcccatcaaataatttatgtacccattccattctatggaggagaagctcaattcctacctcccttgagggtggactggacttagtgacttacttccaaagaata

SEQ ID NO: 35224 - DNA, 189 bp, Homo sapiens
  misc_feature 61: k=g or t
  misc_feature 71: k=g or t
  misc_feature 138: n=a, g, c or t
cattttcacacttcaatcaaacataaagacaaaaacatcaaaaacatgtacatagtgtttkacgtatgtgkatatttacacacatatatgtatgtgtgtttatatgtattgaaactacagaagcacatgtaaccaatnagagctctgagacacctttgaccacttacccttatcagatgagatttgcca

SEQ ID NO: 35225 - DNA, 172 bp, Homo sapiens
taattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacaca

SEQ ID NO: 35226 - DNA, 292 bp, Homo sapiens
  misc_feature 48: m=a or c
agatgacaatgcagattcagaagaggaagaggcagactagtgtaaaamactaacttcagattctgaatgtgaggaacagcaactggaggaaattaaagaaaacaaagggaaactgaaaaagctcaccagactgtacaagaagtgtgtgtcagcatctgcttctgatgaagatttcaggaagcttaaaatcatggtggaaggtaaagtgtaactgggtatattacatggtaagagacagagcaagtgtgaggtgaaggagccaagttctcttaatgaaccagctcttatttga

SEQ ID NO: 35227 - DNA, 149 bp, Homo sapiens
cggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggcacc

SEQ ID NO: 35228 - DNA, 325 bp, Homo sapiens
  misc_feature 199: r=a or g
  misc_feature 200: v=a or c or g
  misc_feature 206: v=a or c or g
  misc_feature 211: r=a or g
aaacgttttcttttatctaatttatattaaatttaattaaaataagccaggaggctagtggctaccatgttagcagcacagtcctatatattctttcacttttgttacatttgttatcaattttaactactattattattacatacaatacaattttaacaataggagattgctattagatgaggctttaacagaaaarvattaavatgaraatatgctataacatttttcaaaacattctcggcctcttgcttattttcctgtatctttctttgaatcttttttgtattttcttttctgtccctgcccttcaacctagaagact

SEQ ID NO: 35229 - DNA, 264 bp, Homo sapiens
ctggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcat

SEQ ID NO: 35230 - DNA, 148 bp, Homo sapiens
  misc_feature 59: s=g or c
catttctctttactggatgtttatttataaagatctggcctgttcctgcgtctgcggasggcccttgtctcccagctatctataaccttagctagagtgtcgccttgtgggttcctgttgctgagacttcctggatggagccgccccc

SEQ ID NO: 35231 - DNA, 334 bp, Homo sapiens
  misc_feature 266: m=a or c
  misc_feature 295: m=a or c
  misc_feature 314: n=a, g, c or t
  misc_feature 322: v=a or c or g
  misc_feature 323: w=a or t
  misc_feature 330: d=a or g or t
tatttaaaatatcttacctttgaaggtcagtgtgtcaattctatttctaatatgtctctgcagtgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcmgtgaggaagaaggtgatagagtagaagamgatggaaaaggcaaaaganagaatgavwaagcagdgctc

SEQ ID NO: 35232 - DNA, 96 bp, Homo sapiens
tatcagctatggtcaacctggtttcatctgtatctctctcttttcacctgtattgtttattgaaaatccaagacactatgccaatgcaaccgttcg

SEQ ID NO: 35233 - DNA, 116 bp, Homo sapiens
  misc_feature 63: n=a, g, c or t
  misc_feature 110: m=a or c
cacgttttaagaaatgtaatacaactttcagcttcctttattagaataatgatggtgatcaanacacaaacaagaggttgttggcggacaccactttatccttgatctcmggcctt

SEQ ID NO: 35234 - DNA, 404 bp, Homo sapiens
  misc_feature 304: r=a or g
tggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaractattttctcttccaaatctaagtactaagctcctagtataaggtgttgttacagaataccagagaccatgttagagacaactacatctcttcaaaaag

SEQ ID NO: 35235 - DNA, 135 bp, Homo sapiens
  misc_feature 67: m=a or c
  misc_feature 69: b=c or g or t
  misc_feature 113: r=a or g
  misc_feature 130: w=a or t
cattatgactgtaaaacatatattcattttgtgagggattttattttcttaaaatataaaggaagamabcagcatatgagatgaaaaacatctcttcctttgtggccattatraaatagacacatttggwacatc

SEQ ID NO: 35236 - DNA, 52 bp, Homo sapiens
aggattctatttatttatttacgtttgataaaacttactggaactagtacta

SEQ ID NO: 35237 - DNA, 278 bp, Homo sapiens
  misc_feature 147: k=g or t
  misc_feature 148: y=c or t
tgctgtttttagaattttctctttgttaatgactttagacagtttgcttataatgtgctgtggagaagacctttttgcattgaatctgattggggtcactggatcgccagtgtctggatgtctaaatctcttgctagacttgggaakytttcatctattattttaagtaagtttttgaactttctcattatctccacaccttcaggaatactgataactcctgtacttggttgctttatggtatgctatttatcacagagactttgctcattctttat

SEQ ID NO: 35238 - DNA, 137 bp, Homo sapiens
taaactaagacgagctctgaagaggaacttttctactttccacactctcttattctacaattgcccctcagtgactccattctgtggaacctggacgctcagccttgatcttcccagggccctcttgcccctgtgaa

SEQ ID NO: 35239 - DNA, 405 bp, Homo sapiens
ggagaacgtggatgtatcgttttaaggtaacaacacggaaaggccaagccccaacaatttacaaagtcatgagcttgatcagctgactcgtgggccctctccataacgagggccacccgcacaggcatgtgggctgggcctggacgtaggcgcctggcccaagggacccaggagcaggggcaccttctccaactcatactaagacaccagtcaggctggtggaagctgcctcatggtcctcaacgttcagttgcaccaagacactaaaacgttaggttctctaatgacgtactttttaaaaaccaggagtgttaaactccgggaccacttgagtctcatacaacttgtgctctggagaaccctgctcagacccccgtaaagctcctgcagaacagcttcacgtca

SEQ ID NO: 35240 - DNA, 235 bp, Homo sapiens
cagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaa

SEQ ID NO: 35241 - DNA, 183 bp, Homo sapiens
  misc_feature 71: r=a or g
ttcctgtatattctctgtactatgtcgattcgacagaacattcagaagattctcggccttgccccttcacragccgccaccaagcaggcaggtggatttcttggcccaccacctccttctgggaagttctcttgaactcaagaactctttattttctatcattctttctagacacacacacta

SEQ ID NO: 35242 - DNA, 363 bp, Homo sapiens
ataatgccactctctcaggtttttgatttctcactttctgttttcaaaaatgtacgcacatccctcgttttttccctatagcaagtggaagaaaatttttctagataatcagacgagtagggaactctgttaatagcttccagccacaggcattggaattgagggcaagtagaacgaggatgcttgtccccaaagatggcaattctcagtgctgggtgagaaggtgcagtttggtcacatgggggtgacgtgggaatctttctttagggtgctgtgggaccagtgactggccagcagaagccagccggggttatggatcatgagttatggatcactagcaggactggcagaattgaaccagcc

SEQ ID NO: 35243 - DNA, 195 bp, Homo sapiens
  misc_feature 99: k=g or t
  misc_feature 102: y=c or t
  misc_feature 106: b=c or g or t
  misc_feature 115: k=g or t
ttcccaactcctgaacacgacacaattttattattagattttgtatggtgattttaggctatgaaaacatgatcattatatgtatatagatacattttkatytgtbacaaatgtktgagcagctcactagcccacccctcctctattttgggtaagagaatttactaccttttttaactatgtagttgagagccc

SEQ ID NO: 35244 - DNA, 67 bp, Homo sapiens
  misc_feature 11: y=c or t
  misc_feature 18: y=c or t
ctctttccgcyatctttycgcgccgccacaatggtgcgcatgattgttctggcagatgctctcaaga

SEQ ID NO: 35245 - DNA, 223 bp, Homo sapiens
  misc_feature 71: n=a, g, c or t
  misc_feature 72: y=c or t
  misc_feature 86: w=a or t
  misc_feature 90: w=a or t
  misc_feature 165: w=a or t
  misc_feature 184: w=a or t
  misc_feature 186: r=a or g
  misc_feature 187: b=c or g or t
  misc_feature 188: n=a, g, c or t
aaccacagtcagtggagcctgggtggtacccaggctttagcattattggatgtcaatagcattgtttttgnyatgtagctgttttwagawatctggcccagggtgtttgcagctgtgagaagtcactcacactggccacaaggacgctggctactgtctattaawattctgatgtttctgtgawarbntcagagtgtttaattgtactcaatggtatcattac

SEQ ID NO: 35246 - DNA, 248 bp, Homo sapiens
  misc_feature 83: s=g or c
  misc_feature 181: y=c or t
ttttctgtaaaatgggatctggacgaatgataccaaacgtttctttctaacattgtattttataactctggcctatgattgtsttgtgtcttgcattaaaaaaaaaaaatttgagagtggtagaattacttctgttatctgaaatacctgagatgcactttaaactgttgaaatgtaagcyctgagggcagggaccgtatcttatttactgttagtatccgttgcatctagtgtggtgcacctggcga

SEQ ID NO: 35247 - DNA, 337 bp, Homo sapiens
  misc_feature 33: h=a or c or t
  misc_feature 64: m=a or c
  misc_feature 234: m=a or c
  misc_feature 298: r=a or g
  misc_feature 300: h=a or c or t
  misc_feature 301: k=g or t
  misc_feature 303: k=g or t
  misc_feature 320: k=g or t
aaactaatacacttattaagtactatctatgahatcatatttaaatttctcagtaaccgttgamataagtattgtcatcctttaccatagacaaggaaactaaggctaaaagcaggcacgtgatatccctaagttcatacaataagttggacaggtggactttaacccattttggcttagtccaaagcctgtttacttgatattacacaatgctactttactgttttgaaagamgaccacatggaacctgatgattgatatccctgaactgttagctggccttaaatttttgtaatarahktkaatagatgtatacataktactttatggcccagct

SEQ ID NO: 35248 - DNA, 85 bp, Homo sapiens
tttaacaacataaattcttccagttcattaacaagggatttgttttcatttatttgttgggccatttatttgtgtcttcttcaat

SEQ ID NO: 35249 - DNA, 208 bp, Homo sapiens
cttttagtagagacggggtttcaccatgttggctaggctggtctcgaactcctgacctcaggtgatccgcctgcctcggcctcccaaagtgctgagattacaggtgtgagccgccatagcagcctgtttaggttttttttttgaaaggaaacaaacccagttaatcagtgtcttgattaactgacttgttaaccagattttgcccgat

SEQ ID NO: 35250 - DNA, 50 bp, Homo sapiens
aatgagaaaaagttaatcacgaaggttattaatttcaattaattatttaa

SEQ ID NO: 35251 - DNA, 326 bp, Homo sapiens
  misc_feature 233: k=g or t
  misc_feature 285: n=a, g, c or t
agggttggcatgactcagcgagtgcatgcgtgcgtcccttccctctgcactgcactgtcatgaccactcaccaaggatctgctttgtctctttcactttcaggacgcttccattgcacacagattccatgtgatgagagagaaacatcctgaaaaattcaacagcaggatgaagaacaagctgtggtactttgaatttggcacctcggagacttttgcagcgacctgcaagakactccacgaccacattgagttggagacctcagtgaccagctccttgaagtgntggggctagaaggagccatggagatggggcagatctacacc

SEQ ID NO: 35252 - DNA, 300 bp, Homo sapiens
tgacttcttattagacagagctcatagtatttgttttctgctccgaacacttaaaaaatactaagacgtgatagtgaaaatagctttgaaaagaaactacatatggcaaaggtggggaggggggaagatgatgcattctgatcattataaagaatacttttcagggctctatcattttctccctttctctaatcatccagaatatggcgggtgtcccagtgttcaacagtatcatgctaatattccatttgatcggtagtccaagttctttggccagatagtgcaatgttgtgacaccga

SEQ ID NO: 35253 - DNA, 141 bp, Homo sapiens
  misc_feature 97: h=a or c or t
caaagcaaaattattaaatagataatgataatatgacacagaaggagtgatagccataaaccttcatgcaatgaatagtattgcatcaacatataahacttaaaatgctagaaattaactgaaacacaattacctggggaa

SEQ ID NO: 35254 - DNA, 151 bp, Homo sapiens
  misc_feature 34: m=a or c
cagaattactaatcatagatcttgaagataagamagatttggaaccacttcagatcaactcgtttttataatggtgttgttgtggaactgaaagattggggatgatttggttttttccttggtccacaggtaggtgtcacaattgctttga

SEQ ID NO: 35255 - DNA, 152 bp, Homo sapiens
caaaaaaaacctgccctgcttcaaggctgtgctcagctggcagcctcccactgttggctcctacagggtctactcagcttttggaccaagtttatgattttctttgggtgtccctgtccaatgactgagcaagatggtggtatgagggcccc

SEQ ID NO: 35256 - DNA, 95 bp, Homo sapiens
tcttttcatgagttatctcatttagtttcacgacagctcaataaggcacttattaaattaccatgtacctttttaagaagtaaatgagggacacc

SEQ ID NO: 35257 - DNA, 345 bp, Homo sapiens
  misc_feature 208: v=a or c or g
  misc_feature 209: w=a or t
  misc_feature 214: v=a or c or g
gtggtcctctgatcaacataggctggtgggagtacaggactcgcctcctcagggttccctgtgctgccacttttcagccatggccacaaggtgagtattggaaccagtgcaggggacagagggatgtcaagaggaaacctagaatcttaacggtgaatgggctgtagaaattatctcaggtccccttagtatactgatcgagaagtcvwtgacvtcagggcagggggcttacatgaggttacacagcaggttagtgacagtctgctccctctctagccgctggtctttccattacacaggcctgtgtctcttgatgcctgtgacctttaatggcttctgagtcaa

SEQ ID NO: 35258 - DNA, 145 bp, Homo sapiens
  misc_feature 112: k=g or t
  misc_feature 117: s=g or c
aggctggcagggctgtggggagggagagactgcctgggaacaggtgaggcaatctcaaccccccggggaccgggaagcctgagtctagaggggcgttcaccccctgggagakcacasgtaaagaaagcgtgtgagccgcaccccc

SEQ ID NO: 35259 - DNA, 297 bp, Homo sapiens
  misc_feature 59: m=a or c
  misc_feature 63: m=a or c
attacatttagcagaaacccttctagctgactccctgaatggatgaccttgtttaagamagamatgtgtttcatggtaagcacagtgctggtcgggaaggacctgtggggatactgcatttttatttagggtgtctttggtcctcttcctcccagtttcgttttgttttgtttttttgagatggaattttgctctttttgcctaggctggagtgcaatggcgcgatcttggctcgctgcaacctctgcctcccgggtctaagtgattctcctgcctcagcctcccgagaagctggaa

SEQ ID NO: 35260 - DNA, 170 bp, Homo sapiens
  misc_feature 100: n=a, g, c or t
  misc_feature 101: h=a or c or t
atccttgcattttggaaggctgaggcaggaggatcactttaggcctggtgtgttcaagaccagcctggtcaacatagtgagacactgtctctaccaaaanhaggaaggaagggacacatatcaaactgaaacaaaattagaaatgtaattatgttctaagtgcctcccca

SEQ ID NO: 35261 - DNA, 55 bp, Homo sapiens
  misc_feature 2: s=g or c
asagcaattcggcggcccctgcagggcagctgaagccatggaagcctccgcaggt

SEQ ID NO: 35262 - DNA, 142 bp, Homo sapiens
agttcgctccgactgcccgagcgagggcgcttcgctcccagccaggacatggccgcacctctcctcatcaggagcgccggctcacggacttctcgcccaactccctgagcgctccctcgtttcgatctttagaaaaccccgc

SEQ ID NO: 35263 - DNA, 208 bp, Homo sapiens
  misc_feature 78: m=a or c
  misc_feature 158: m=a or c
aacatgcaagtaaagtagcttgtaggcagttaggagataggactgggttttgtgtgagggttaggaggttataatgamaattttaaaaacagcaacataggggattttgctaaagccttcaggggggatgacttctcacagtgaaggcatggagagamagaggatggaatggctttagacagttctcttttcctgaggagaggcctga

SEQ ID NO: 35264 - DNA, 269 bp, Homo sapiens
  misc_feature 2: m=a or c
  misc_feature 11: h=a or c or t
  misc_feature 124: r=a or g
  misc_feature 216: d=a or g or t
amatagatgthttaagctacaaagacaggtaattgtcttgaacccaggccatgctgtggagacgttcactgtccgtagactagttttgcattgacagtagaaacaggaaagtaaattgctaaaraacattcatttttctttgacttcagccaggcacagtggctcatgcctataaccccagcacttttggaggacaaggtgggaggattgcttgadccgaggagtttgacaccagcctgggcgatatagtaaaaaccccgtctctacca

SEQ ID NO: 35265 - DNA, 87 bp, Homo sapiens
gcgctaaccagccgctctgcgccccgcgccctgcttgcccccattatccagccttgccccggcgccctgacctgacgccctggcaat

SEQ ID NO: 35266 - DNA, 411 bp, Homo sapiens
  misc_feature 182: b=c or g or t
  misc_feature 183: w=a or t
  misc_feature 184: y=c or t
  misc_feature 185: k=g or t
  misc_feature 223: k=g or t
  misc_feature 228: k=g or t
  misc_feature 361: r=a or g
  misc_feature 367: s=g or c
  misc_feature 393: w=a or t
ttagaacactggtacagatacccatagtatcagtgtggtttgtaaacttactttgcagtgtttctcatctgatttgctacttagagcctgcaaatttgataaggccccgatttcacccctacctggtggtatttatgctatcataatctcatactgaccaaggcacctaaaggctcaagttbwykcgtaattttgttgttgttgttttgtgggtttttttttkgtgtkgtttgttttgagacacagtcttggtctgtcacccaggctggcgtgcagtggcacaatcttggctcactgcaacctctgcctcctgggttcaagagcttctcctgcctcagcctcccaagtagctgagattacrggtgcstaccaccatgcctagctaatttctgwatttttaatagagacggt

SEQ ID NO: 35267 - DNA, 154 bp, Homo sapiens
cgagacttggacacttggtataaagaacagtctgcagccatgtcccaggaggcagccagtccagccactgtgcagagcagacaaggtgacatccacgaactgaagcgcacattccaggccctggagattgacctgcagacacagtacagcacgc

SEQ ID NO: 35268 - DNA, 281 bp, Homo sapiens
  misc_feature 125: w=a or t
acaagcgattctaaaccacctatgagtatttcttttagggctcacttaaatacatgtttgtatatactgtattctagccagaataattttagatctgatcaggtagtagctaaaattagaaaaawacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaaca

SEQ ID NO: 35269 - DNA, 61 bp, Homo sapiens
  misc_feature 56: k=g or t
tcgaacacgcaaggctgtgagactacctattgtagatattgcaccctatgacattkgtgat

SEQ ID NO: 35270 - DNA, 269 bp, Homo sapiens
  misc_feature 258: w=a or t
tgagtcctcggtttgctatttggatgtaacctcaggtaaaacatttatcttttttaagcaccgatttcctgttgtgaagaaggttgtaaatagtgttgttgtgaagattaagtgagataatatatttgaatggtagagtatgatagctggcacagaattactattcaatataagttgatgatggtgggtggttatgatgatgcaacagccacatatagtcagaggtcagtattttaaatcatttttctaaggcttttwagcaggtctta

SEQ ID NO: 35271 - DNA, 340 bp, Homo sapiens
  misc_feature 262: m=a or c
  misc_feature 263: w=a or t
  misc_feature 281: m=a or c
  misc_feature 282: m=a or c
acttaggacaccgatgggaggatgtggtggtgatggaggcagagctgtgaagaactgagaggctattaagaaaaccgcggtggaacagtggctggggaaaaggattgtatttgctggggctgctattaaaaagtaccgtgaactgagtggcttaaacaccagaaattattctctcacagttctggaggactaaagtccaaaatcaagctgtgggcagggtgggtttccctgagagctgcaagtgaaggatctgttccaggcmwctctccttggctgatttmmtggcaaacagaaaaagctctcttggtctttaaagttcatgacagattccctaagtgtt

SEQ ID NO: 35272 - DNA, 294 bp, Homo sapiens
  misc_feature 249: v=a or c or g
taattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgavgggcatgctgtaatttcacacaattttccagttcaaaaatggaga

SEQ ID NO: 35273 - DNA, 194 bp, Homo sapiens
cattttttgacatgtggttatttggaaactgaaaatagtcatgacagttataatagatcttttcctatgggaatagaaatgttctctgccctgagctatatcacactatttaaacagggtatctttagttctttcattgtaatatactcataaataaactagaaacaagtatacacaaacacacacacaaaccc

SEQ ID NO: 35274 - DNA, 231 bp, Homo sapiens
gtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggc

SEQ ID NO: 35275 - DNA, 341 bp, Homo sapiens
  misc_feature 38: y=c or t
  misc_feature 69: k=g or t
  misc_feature 78: k=g or t
  misc_feature 185: k=g or t
gcgaaccgacctggagcccgaggggaaagatgctcgaytctcttgggggcaccggagcgggcgcaggakaggcctgckgggtgcgtcccactcacagggatcctctttcagttcatttagataggtgccctttgggcccttgatattcaacggctatgtgttcacgttcagcacgctcggctgakagctttcatttttagggcaaacgagccgagttaccggggaagcgagaggtggggcgctgcaagggagccggatgaggtgatacacgctggcgacacaatagcaggttgctctttgtgctaagactgacaccatgaggacacagatttgggggggca

SEQ ID NO: 35276 - DNA, 301 bp, Homo sapiens
  misc_feature 281: s=g or c
tggaaagatactcatgagccaccaattaatgcagatgttgtgtttttcattaagaccatcacaccagactgcctctcatagatgatccaaatacatctaatgggataatagctcactggggtgcttagagcttgatacttagagacaagtggagctcttgaatgtgtgtgcacattgagtttcattcttttaacttgtacttggaagcacatatgctcctttctaaaatgctaacctttccaaatttggaaaagcagtttcctgaaatgcgtacacttggscctcaagtacttgctacttc

SEQ ID NO: 35277 - DNA, 169 bp, Homo sapiens
  misc_feature 137: w=a or t
  misc_feature 138: w=a or t
  misc_feature 139: m=a or c
ttcctgctccgtatctcagtctgcactgaccccagggctgggctgacatcaagatgggagcccagcccacgggctttataaacacccaagaaccgtttcaaatcttctctgtgctgatgcaggtagttttaaatttwwmtcagttccagtgatagaaaacccacaccgc

SEQ ID NO: 35278 - DNA, 270 bp, Homo sapiens
aaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccgt

SEQ ID NO: 35279 - DNA, 212 bp, Homo sapiens
  misc_feature 70: m=a or c
caaataaaattaaatcacagttcagatgaaactgaatatcattgtaataatctcataatatatatttgtmactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacac

SEQ ID NO: 35280 - DNA, 253 bp, Homo sapiens
  misc_feature 144: n=a, g, c or t
  misc_feature 183: v=a or c or g
  misc_feature 221: b=c or g or t
caagttttcttttttcttcttaaattgcaataggcttccaaaaagagtataattgtttcagaacaaattaactcttggcattatacgtctccctttttctttacagtattagtaaaatgaaaaattgtacactttctgattttnacttcactaatgtaattactctctcaagaagcttttaavatttaaattaccatcacacaacctttttatagtaaagbcaacatttgttctctcaccaaaccccacgcca

SEQ ID NO: 35281 - DNA, 148 bp, Homo sapiens
agcgacgtgtcaagggcaaaacagcagcagcagcggctgcctctcccaccgtcttaacccgaactcgggcttgtggcgtcctcccgtgggccggatagagtgccctagtccagctaacggattcagcctggagcgttctgcgtgacat

SEQ ID NO: 35282 - DNA, 282 bp, Homo sapiens
  misc_feature 48: v=a or c or g
  misc_feature 52: s=g or c
  misc_feature 97: r=a or g
atttctccaaactaaagctctcatgtttttggaagggctgcctttgcvagtsaggtttctgagaaatgactgttgttcccaaaacaagagggagctrggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagcc

SEQ ID NO: 35283 - DNA, 294 bp, Homo sapiens
  misc_feature 38: k=g or t
  misc_feature 94: y=c or t
  misc_feature 96: k=g or t
  misc_feature 111: w=a or t
  misc_feature 261: r=a or g
  misc_feature 270: w=a or t
ctggtgtagtttaaaatgcctttgggggcagtttgaakcagttcttcatgccacttagtttgaaaataaaattctagatatgcaaatgattttytkagaaaacttcacaawataaaagatcttgtttttttttccatagcacagtaatgaatgtggttatcaatcacatacttttttggattatattgtagcaaaaagttgattagcttaccaagattattaatagcaatgtatgtgttataatacaacttagtacattaragctacgawaactcatcctggctgtaggatagt

SEQ ID NO: 35284 - DNA, 173 bp, Homo sapiens
  misc_feature 62: r=a or g
aaccacatgagaagccagaagcaagggctagtaaggattattctggcttccgaggcaatatratccccaggggagcagcaggaaaaatcagggaacagagacgccagtttagccatagggctatacctcagggagtgactcgacgtaatggcaaagagcaatatgtgccacaa

SEQ ID NO: 35285 - DNA, 56 bp, Homo sapiens
attttgtcccagtcagtccggaggctgcggctgcagaagtaccgcctgcggagtaa

SEQ ID NO: 35286 - DNA, 291 bp, Homo sapiens
  misc_feature 91: r=a or g
cagtggctcacacctataatcccaacactttgggaggccaggagttttgagaccagcctgggaaacatctgtctctacaaaaaaatacaaraattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacga

SEQ ID NO: 35287 - DNA, 190 bp, Homo sapiens
  misc_feature 40: n=a, g, c or t
  misc_feature 96: m=a or c
  misc_feature 122: m=a or c
  misc_feature 128: v=a or c or g
  misc_feature 169: v=a or c or g
  misc_feature 174: n=a, g, c or t
ctttttctggtccagagcccccacaggaaggagaaatganaagattactgttgactgcacagttccaggggccaaggcagaagacatcctggagamaggtccaaagacagcgatctcctggmcatgavagatggacaagctgatacccagcttgaagctctcaagagavcaganaggcgtctcacactct

SEQ ID NO: 35288 - DNA, 226 bp, Homo sapiens
  misc_feature 189: b=c or g or t
agacacccatctgtggccttcacttcctccccttgtgggtgttttctctgcaaagatgcaagaggtgtgttcgggggaggacacacatgggggtcactttccttccagacctgggcacaccggcgctgagcaacagtgtgtacaagggcgcctcaccctatggctccctcaacaacatcgccgatggcbtcagctccctcaccgagcacttctcagacctgaccct

SEQ ID NO: 35289 - DNA, 356 bp, Homo sapiens
  misc_feature 40: k=g or t
  misc_feature 51: k=g or t
  misc_feature 61: d=a or g or t
  misc_feature 63: w=a or t
  misc_feature 64: r=a or g
  misc_feature 70: k=g or t
  misc_feature 73: k=g or t
  misc_feature 261: m=a or c
ctctctgtttttgactttggagataaagttactgattttkatctttacttktctctttatdtwrtgcctkggkcttgaaaaagtaataaatatttcttactgaggccccctcctgctttgttctgccatctaaggtgattacaatgctcaagtctctttgttggttgcctttgactaatgcttttcagcagccccgggctcagctcctggttcccagtatggcacaatgaccaggcagatatctcgacacaactctactamttcttcgacatcttctggtggatacagacgaactccctctgtgactgctcaattttctgctcagcctcatgttaatggaggtccactttattctc

SEQ ID NO: 35290 - DNA, 183 bp, Homo sapiens
catgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccat

SEQ ID NO: 35291 - DNA, 161 bp, Homo sapiens
ggaatataaaagtaaatgtgtcatatgctgtcttgtggaaactcacagcctggtagtatacaggtctgtaagagatcaagtaggagtttgggaaaggtttcaggaaagagggggtattttggtgtttgatttttgttgacttttttttttttttttttttt

SEQ ID NO: 35292 - DNA, 282 bp, Homo sapiens
catatgattagatgagacccacccacattattggcaatctcctttacttatagtcaacggactagatgttaactgtgccagcaaaataacctttatagcaacatctagattagtggggtttttgtttgttttttgagacagagtctccttctattgcccagactggagtgcagtggcgcgatctgggctcactgcaacctctactctcaggttcaagtgattctcatgcctcagcctctcaagtagctgggactgcaggcacgtgccactacacccggcgac

SEQ ID NO: 35293 - DNA, 208 bp, Homo sapiens
  misc_feature 29: w=a or t
  misc_feature 74: k=g or t
  misc_feature 76: k=g or t
  misc_feature 94: y=c or t
  misc_feature 199: y=c or t
aaggaaaccaacagcggcctaggggtgawaggacagccagggttagatgttctgaggaggcgggagcaaccgakakagcacgtgagcatctgtyctttctacccgttcctctttatctttagtgttcagtagcagcggggatagcccggggcccggtgtatggccacggagttacagtgtccggactccatgccctgtyacaaccagc

SEQ ID NO: 35294 - DNA, 379 bp, Homo sapiens
  misc_feature 325: r=a or g
  misc_feature 358: r=a or g
acattccacttagacaatcaaacttgaagtgtttacggtctagggtagatgtccaacagggagcagggactatcaatctggaactcagagacgaaaccatggagtgacaggtgcaggttaagagcctgttaggtccaaaatggtgccccagaaattcaagttaagtcaagcccatgttggaagaccaccagtcctggccgaccaaccctgccctcagctgggcctcaccagccaaccaccatgagcacacagaatggcagtgacacacaagacagcccagcactgagtgactcagtcattacaacctatcacctaaagccaacaragattgtgacttggttcaccaaaccaataggargtcaacattattcgggaggcc

SEQ ID NO: 35295 - DNA, 272 bp, Homo sapiens
tgaacagtgtccccggggcagggactggcgccctgtgcctgagtgggtctgaaaaagctttgagagagaaaaaaaaaaatctcctgattagctttttacttttgaaattcaaaaagaaactaccagtttgtcccaaaggaattgaaattttcaaccaaactgatcatggttgaaatatcttacccctaggaactggataccagttatgttgacttccttctgcatgtttttgccaaaacagaatttggggcacagcatcttttcacagggag

SEQ ID NO: 35296 - DNA, 243 bp, Homo sapiens
cagagttgtgctttatttaggaccttaaggggttggttggagggaatagagactgaatttgtaaagacaaaagttaagagtctgttgtggtggttcaggtagaataacagcctgaatcaggctggtggctgcggattggcaaaaagggcagacatcagggaaggaggcaaggtaaaatgctagaatcatcaggactggactgaggagactggtggctagagagatggtattgtcattgtcagc

SEQ ID NO: 35297 - DNA, 210 bp, Homo sapiens
tatttgtattcagagttttagtttggaaaaaatggtcattgtcttattggtccctagctcaatgccttgcttattaaatgcactgaataaattcttttgaatgagatggatattgtaaaattctcatgtgcctcctgaagccttctaaattgtttttattttgagtgtattatattaagttccatttgtaactggttctgtatggtgacg

SEQ ID NO: 35298 - DNA, 214 bp, Homo sapiens
  misc_feature 83: r=a or g
cttccaagatggcggcgcgtccgtcgcgagcgaccgggccgaggggaggccagcgaaccgagtaaaaccgccgcccgggagargactgaaggagcagttgccgccgttggcgcggcccgagcagttttcgctgctgctacggctgttgccatgaggcgaggctagggaggacctcacttccccggggtgtaataatgttaactgagaccagtcc

SEQ ID NO: 35299 - DNA, 153 bp, Homo sapiens
ttagtagagatggggtttcaccatgttggccaggctggtcttgaactcctgacctcgtgacccgctcgccttggcctcccaaaagtgctgggattacaggagtgagccaccgcacccggccagcaattttttaatattgttgaatccaacaca

SEQ ID NO: 35300 - DNA, 304 bp, Homo sapiens
  misc_feature 91: r=a or g
  misc_feature 131: w=a or t
  misc_feature 177: n=a, g, c or t
  misc_feature 252: k=g or t
  misc_feature 254: k=g or t
caatggtgtatgagtgttttacatgctataacagggcagcatagttcaaggatatgtcttggaatttggagaggcagattcctcaattttragaatagaattttccttgttagctatggccttagtctggwtgcagagaatagtacctggatttcctcaactgaaagtgtgattatnaccccttcctttcaggatttgtgagggttagagacaatgtatgttcaatgcctagcacataatgggccagccacktkcaataataaaacataccaacaatgtgggtaggtgcaaagaatttgttgac

SEQ ID NO: 35301 - DNA, 335 bp, Homo sapiens
  misc_feature 93: r=a or g
  misc_feature 99: k=g or t
  misc_feature 261: n=a, g, c or t
  misc_feature 262: v=a or c or g
  misc_feature 263: k=g or t
  misc_feature 329: r=a or g
gattccccgctcgcgactccccaccccccagggctccctaaagagggccacgagctgcgaaagggcgggaaaggcagttggagaagaggtaargcggtkactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgnvkcaaggtccagagaaggtggaggaatcctgatactgagcggaatcttcccaaggctgcagacaccgrctcatc

SEQ ID NO: 35302 - DNA, 229 bp, Homo sapiens
atgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtac

SEQ ID NO: 35303 - DNA, 320 bp, Homo sapiens
  misc_feature 172: r=a or g
ggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggarcattactgaaagttttccaggctctattctaaatgatttcaataaacaatcagaaatcttgactatgcttccagaatctgttaaatcaaaatatcaagacctactggcagttgaacatcaaggggtgaaactgcttgaaaacagacgt

SEQ ID NO: 35304 - DNA, 216 bp, Homo sapiens
  misc_feature 96: y=c or t
cagagcactttttactaagtagtagatgaattttcagctatgcaatatgacaaaacatggggaattttgaagattgtcattttttcattcgagtcyctatgttaaacattccatattttgaatatttatatcttgtacttgggtttaagagaagtagctggctctcaagattgactggctatttattataaagtactgaagtcacatagccacccc

SEQ ID NO: 35305 - DNA, 356 bp, Homo sapiens
  misc_feature 323: h=a or c or t
  misc_feature 330: m=a or c
  misc_feature 332: s=g or c
  misc_feature 335: s=g or c
cactgggcctccagatcgcaccaagaagctgaaatccaccagatcacagcatctggacaatgagatgagagacacctcacccttcatgattgcccagctggccacctgctcccattgaccagctcttccttaccctccctaattcccattttctcacacacagatgcatttcttccctgctaaaaacccctaattttaggtggttgaggtcatggggtgactctgagtaacagtcagaggaacctccaaatgggtttccgaggtggctgctctttacattcccatgagcagtacagggggcgcggtttccccacagccttgchgtcgttmgsctsccattttcagtgattttattt

SEQ ID NO: 35306 - DNA, 258 bp, Homo sapiens
  misc_feature 72: m=a or c
  misc_feature 73: m=a or c
  misc_feature 256: m=a or c
ttttatattagtccatgatagtttgtatgccctaaaacaaagtgaataacctcattttgtgtttcatatgtmmtttaattgcccagaacaaaatctgtattacttttacttattatggctatgtgtataattatatgtctagttttcttttttttaacagttaacttgatattctataccacttgaatatttttaattctggaaaatcagtttttcctagtgctcccttttccaactcttctcactccttcctccmtc

SEQ ID NO: 35307 - DNA, 236 bp, Homo sapiens
tccaaagaggtgacattgtgattgcaaaaagcccaagtgatccaaaatcaaatatttgtaaaagagtaattggtttggaaggagacaaaatcctcaccactagtccatcagatttctttaaaagccatagttatgtatttggaaactaagcagttcctattaagatgctgttgctggccggccgcggtggctcacgcctgtaatcccagcactttgagaggccaaggcaggcagat

SEQ ID NO: 35308 - DNA, 204 bp, Homo sapiens
  misc_feature 115: w=a or t
tgtgagttttcaaataggagtctttttctgcaatttgtttgcattttttagaagtgcaaacagtaagtaaataaaagccttcggtaataatcatgacaatacaagaggctgagcwaggctacaggggaaaactattgtgttgtaaagttgcatcgctattttatattaaaatgtaatgatcagcatcatgaacaatgagctctc

SEQ ID NO: 35309 - DNA, 63 bp, Homo sapiens
  misc_feature 31: m=a or c
tttcccttttgtgataaagtagaacagggamaagatgcagtcttttgggtagtctacttaact

SEQ ID NO: 35310 - DNA, 339 bp, Homo sapiens
  misc_feature 190: n=a, g, c or t
  misc_feature 194: s=g or c
  misc_feature 205: n=a, g, c or t
  misc_feature 213: n=a, g, c or t
  misc_feature 214: b=c or g or t
  misc_feature 217: v=a or c or g
  misc_feature 339: n=a, g, c or t
catgttgggggaaggtatatatattaattatgtatacattaatacataatgtatgtattaaatcacataaattagcattctttagtatcccttttgtctcgctctcctttctcatcatgttgttgttgtttggagtttttgacattagttattctagataaacattctcttcttcagtcttagccttttntttsagacagagtcntgctcaanbgcvcaggctggagtacagtggcacgatcttagctcactgcaatctttgcctcctgggttcaagcagttctcctgcctcggcctcccaggttgctgggattgcaggcaacaaccaccacgcccggn

SEQ ID NO: 35311 - DNA, 255 bp, Homo sapiens
  misc_feature 17: h=a or c or t
  misc_feature 92: r=a or g
  misc_feature 108: r=a or g
  misc_feature 109: k=g or t
  misc_feature 148: r=a or g
atgtgatcagtctagghccttcaatgaacatgggattctgttaccaagccttgtacgtactgtgtgcaaggagccgtgccacaggcagatgracagtctggtaggagrkctgggcacatacacctggatataacactctgcaaaagargatgggcaatgtgaagtcccccagaactctaggagctcagagctggaattgggagctgggcgtatattgtactagaaaatcagtggtattatcacaaaggaaaagct

SEQ ID NO: 35312 - DNA, 149 bp, Homo sapiens
caagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaagcgg

SEQ ID NO: 35313 - DNA, 137 bp, Homo sapiens
  misc_feature 137: k=g or t
gagatctggcatttactgagcacctatgacatttgccatctgccaggtacctcatggggcactttatacacattattctatttaagactcacagccaccctgtcaatcaatttatgattatttattgagacccctgk

SEQ ID NO: 35314 - DNA, 164 bp, Homo sapiens
ccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggaccc

SEQ ID NO: 35315 - DNA, 295 bp, Homo sapiens
  misc_feature 18: w=a or t
  misc_feature 85: r=a or g
  misc_feature 172: m=a or c
  misc_feature 284: n=a, g, c or t
  misc_feature 292: n=a, g, c or t
taacttttattcaatatwacattatgtagatatgtaatacaaagaaaatatttaggagaatggcaaaacacaaatggcaacataratgtccatttgactcacctaacttcacaactttcaagttgaggatgtcatttattcttgaatttgtttttttactagatgctttcamttaatagccctatatttttgtgcaggcgaactgtataacaggataaaaaatgatttgtatgtattgaaaaggaggagaaattctcacagaacaccatatgagctttagaccngaaggggncaa

SEQ ID NO: 35316 - DNA, 112 bp, Homo sapiens
aaaaatgtgtttcactgaaaatttaaagaaatatttagaactcttttcagtggtatataatgagggcaatttagtttaactccagcctcccaacctcccactccccacctct

SEQ ID NO: 35317 - DNA, 112 bp, Homo sapiens
catattgctgcccaaaagtatgactgtggaggaaaaaaaaatactttaaaaatccacactttttgttaagaaggaaacatttagcatttatatatttgtgtatggaaaacac

SEQ ID NO: 35318 - DNA, 97 bp, Homo sapiens
cagtctaatatgcctacctcaaatgatgacagaatgacatctatatgcatatgaggcctacgttagttgaaagatgctataaagatataagggatta

SEQ ID NO: 35319 - DNA, 284 bp, Homo sapiens
  misc_feature 265: m=a or c
  misc_feature 266: m=a or c
ttcctgaggcctccccagccatgcagaactgtgagtcaattaaaactcttctgtttataaattacccagtctcagatagtacctctatagcagtgtgagaatgggctaatgcagaggtgcatgaggtattttttatttaaagaaaatggtgatattttctttttttttgagatggagtctcactctgtcacccaggctggagtgccatggtgcagtcttggctcactgcaacctccgccccctgggttcaggcgattctactgcmmtcagcctcctgagtagct

SEQ ID NO: 35320 - DNA, 173 bp, Homo sapiens
  misc_feature 149: w=a or t
tgtaaaatttctctctttgtattctttctctttatttctcagaccggctgacacttagggaaaataggaaagaacctatgttgaaatattgggggtggttcccctgatagttgagcaagaaagttttgtagaaaatttgggtgaaagawatgcagagatcttgttccaggcgg

SEQ ID NO: 35321 - DNA, 375 bp, Homo sapiens
acacaagggatggatcagtcaaagaacacagcattcaggatttatctacactactagaaggaaatattatcagggaaatgacagcaggacttcgtgggaagatgtggaacgccacagggaaaggaaaaggctttggggttctttcctctgggaggtaaagtgcaagctaattttgctttggtgtttttttgggatttgcaggaagtagtcattatgtcagaatccatgaagattgagttccaattatcaaggggtgaaaatcgccaagcaaatatttgtcattgataagatacttcataatcagagtggcttctcacacccatagtaagctctgctggcagggctttcgaacttgaattcctgctcgacactaat

SEQ ID NO: 35322 - DNA, 97 bp, Homo sapiens
  misc_feature 45: y=c or t
  misc_feature 86: m=a or c
aacacatgttgtatactggtagagaggcattagaacaagtatttyatacagatactgactctgtgcaggctgaaatagctctagamacctgctatga

SEQ ID NO: 35323 - DNA, 219 bp, Homo sapiens
  misc_feature 200: m=a or c
gtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagamactctataataggccacct

SEQ ID NO: 35324 - DNA, 243 bp, Homo sapiens
tataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaa

SEQ ID NO: 35325 - DNA, 289 bp, Homo sapiens
tttgtgattagatttagttctacatttttagcaaggagaccacagaagtgatgttgatttcctaacccacagcactgtgcatttccaaacccacagagtcctcaaccactgaaagatgagagttggtgtttaaaatcccatgtccctccccactcagttggagggataactctgaggtgtgttctacaccgattcccagagttccccagtgggattaagttgcccacagcagaaactggttttataacatcgtttattgactgccttctctcctatctcatgtcccccc

SEQ ID NO: 35326 - DNA, 189 bp, Homo sapiens
agactaagaggtgttccccattcggcagccagactccttgaaataccctttcagtaatcattcaaccaacgcttccatgtctctactctgtcgtaacaaaggctgtgggcagcactttgaccctaataccaaccttcctggtcagagttgcctctgaagctgctgccgctaaatatatcccaagcccct

SEQ ID NO: 35327 - DNA, 153 bp, Homo sapiens
gactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagc

SEQ ID NO: 35328 - DNA, 327 bp, Homo sapiens
  misc_feature 17: s=g or c
  misc_feature 42: s=g or c
  misc_feature 302: b=c or g or t
aaacacaaatgactgcsttctgcctgcactcgggctattgcsaggacagagagctggtgctccattggcgtgaagtctccagggccagaaggggcctttgtcgcttcctcacaaggcacaagttccccttctgcttccccgagaaaggtttggtaggggtggtggtttagtgcctatagaacaaggcatttcgcttcctagacggtgaaatgaaagggaaaaaaaggacacctaatctcctacaaatggtctttagtaaaggaaccgtgtctaagcgctaagaactgcgcaaagtataaatbatcagccggaacgagcaaacagccc

SEQ ID NO: 35329 - DNA, 123 bp, Homo sapiens
gatctccagcaggagcagctctacgcgggagccttttcgagctgccgagccacggaagtcgacccctgcccagcctctgggatcgcgggccctgtggggaggggcggaggagaccacgccgga

SEQ ID NO: 35330 - DNA, 259 bp, Homo sapiens
  misc_feature 42: k=g or t
ctaactgaaatgtcatatcctttgaccaatatcttgccaatktcctctcccaacccttctcttttctggctccactttggaaagcatttggctcttggggggccccacctctaaaatgtctctggaatccccttatctctaccttatctcaactggacatgccagagcaccctcttctggcctccaaaatgctacgccctgcatggcaaccaacacctgagaatccctgcattattcaaaatagaaccaagggcaacgc

SEQ ID NO: 35331 - DNA, 157 bp, Homo sapiens
gatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttc

SEQ ID NO: 35332 - DNA, 131 bp, Homo sapiens
taaaacattttagaaatattctagagatgggcaggagagtcaaagggcttgcttgccccagcagagttcccagcagacagccatggctcttcccagcagcctgtgcaaattctgatgatggccccccccca

SEQ ID NO: 35333 - DNA, 274 bp, Homo sapiens
  misc_feature 79: k=g or t
  misc_feature 274: r=a or g
tttgactttagaacattgtcctaacttttttcagtgagaaggtgattggtttgtgatttatttctggtaattttatgcktctaagtctgatgcaagacattttaattacattttttagtttggaagagaaaggctttattgggaaattgatcggttttcataaaacaaatctgtcatatttaaaaatgggcctgcatagaatatagtgtgtatgaaaagtggtggctacagaatccttgtagttaaagctcagaaagttttgatagccagcgar

SEQ ID NO: 35334 - DNA, 251 bp, Homo sapiens
actaataaaccaaaccaatgtttattccttcaggccatacctaagatattccatgtggcgctggctgtaacaggcccccccgcactgatttacactcacaacaccctaggctcacttgaggcattcttcctttaccagtcaaatgctcccaggtcatatgccagttaaactccaccatgttgcctcttagtgcacatgcttgagcccactcgcccagctcctgagatcttatcgggaagctgctgatcacc

SEQ ID NO: 35335 - DNA, 150 bp, Homo sapiens
taatttatttgagactggattttatcactcggagctaaaccctatgaacatgtgcagtgaagagtcagagaagaccagcaaaaagattgaaaatgggcattgccgtccctgaatcctttatgaatgaagtttctgtaaataacctgggtc

SEQ ID NO: 35336 - DNA, 192 bp, Homo sapiens
catcgtacattaaggaattgcgtaaaatgtttagctgtatctgtaggctccaggtaacttaattttttaattgtattactatgatgttcagtaaatgctgagtgaacttacattctttaaaatacatcaaaagaggctgggtgcagtggctcacacctataatcctagcactttgggaggccgaggcggggg

SEQ ID NO: 35337 - DNA, 315 bp, Homo sapiens
  misc_feature 271: r=a or g
aggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaarattaaagaagaaccagacaatgctcaagagtatggatgtgtcca

SEQ ID NO: 35338 - DNA, 139 bp, Homo sapiens
cttggggatccttttattataattcacagtatctcactgctaaatgctgaagaacattctatagctaccctacttcttcgaatagagaaagaggaattggatatgaaaggaagtggtttctatgtttctctggagtggt

SEQ ID NO: 35339 - DNA, 231 bp, Homo sapiens
tatagtactactctgcatagattttgcatataataatagcatgatgctggtagtggattttgtttttctgaactctactaatgtgtattttacaactatctatacatttttcttttttaaaaggacactgtcaagtacttttaaactgttaattgtaattttaaaaatttcctgcatgtatttatttttatttctattgactgctctttgattttctttcttggaacggaa

SEQ ID NO: 35340 - DNA, 187 bp, Homo sapiens
ccactccacaaaccactaaaattttagttttagcatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggccc

SEQ ID NO: 35341 - DNA, 177 bp, Homo sapiens
  misc_feature 64: m=a or c
  misc_feature 68: h=a or c or t
aaaagatccaacttataataatatctaagaataaacacaatgagaaacatgtaagacctatatmagahaaacttaaatgaagctgggggcggtggcctgggcaatgtggtgaaacaccatctctacaaaaaatacaaaaattagctgggtatggtcccagctactttcagggggcga

SEQ ID NO: 35342 - DNA, 276 bp, Homo sapiens
  misc_feature 177: r=a or g
gactaggtagccttggaccttttctgtgctatcgagtctaaaggaaagaaagatttctgcaactgaaggggcagtcgggtagtattacatttaagatattaacgcccgacctggctcacaggagtgtgggaacaggggcggggaagggccttagcactgagagccgaaaagtataaracgattagtttcggcgtcaggcgttttgaaaggctttgcaggtcctgttttctgcgtaatttttccgtgattactgactggtttaaacacgaccccgac

SEQ ID NO: 35343 - DNA, 220 bp, Homo sapiens
  misc_feature 77: r=a or g
aagtcccataaggcattggagcctctgggaaaggaaagtgggagggtaaaggcagggaggaagaagaagctgtagtrgaaggccttgtgggcatgagaaggatttgggattttattttgaataacatgagcagtgtttaagcagaagcatggcatgatttcttacacctgtaaataatttctctagtcatggacagagaataagttgcaacaaggcaaaa

SEQ ID NO: 35344 - DNA, 275 bp, Homo sapiens
  misc_feature 72: r=a or g
  misc_feature 74: r=a or g
  misc_feature 220: r=a or g
  misc_feature 232: v=a or c or g
  misc_feature 247: k=g or t
tctttatttttcagagacgtccccgtttccaattatgtttttatttagctatattgcacttgactgcattgrarggctgttcccagagtaagtttgtttgggggaaggtgtttatagcctgaatcaaaattattttgagtttaaaagcacaattttttttaaaaaaagtgttgagtctgcagggtgtaaactcattttgataataaaagatgtggttaaraaggtgaataavaatctgttatttttktctttttcagttttaaataattgccatc

SEQ ID NO: 35345 - DNA, 332 bp, Homo sapiens
  misc_feature 199: d=a or g or t
  misc_feature 218: d=a or g or t
  misc_feature 271: d=a or g or t
  misc_feature 273: r=a or g
aataaaaattggcagaagagagtgaggtaatcccagaaggagttcaccagatagagttgacataattttccaaccctgctctgatgttaatcctccgtttacggaaagtgtctatagaaaggtacatactcagatagagttgtagatcgtctgcctatctccatattggttcacagaaactgctgaagagtagattttdaagaatcaaaataattaadtgtccactttaattcagataaaaattaaggaaataattcagattatgtttttdaraacaatgactttttattaattcactaccatgtgacttttcttcttgaagattgatataa

SEQ ID NO: 35346 - DNA, 372 bp, Homo sapiens
  misc_feature 269: n=a, g, c or t
  misc_feature 273: m=a or c
  misc_feature 286: n=a, g, c or t
  misc_feature 287: b=c or g or t
cacaagctgaaatggtggattggatatctgcagagaaaattcaaaaggaacctcagtgtggaggcagaggttgatttactcagttattgtgcaagagaatggaaaggagagacaccccgtaacaagctgatgaggaaggcttatgaggagctattttggcggcatcacattaaatgtgttcgacaagtaaggagagataactatgatgctctcagatcagtgttatttcagatattcagccagggcatctcttttccatcatggatganagamaaggacattgtanbagcttcctgaaaaactgctgttttcacaaggttgtaattggattcagcagtacagttttggtcctgagaagtatacaggctcgaa

SEQ ID NO: 35347 - DNA, 381 bp, Homo sapiens
  misc_feature 2: k=g or t
  misc_feature 49: w=a or t
  misc_feature 61: r=a or g
  misc_feature 62: r=a or g
  misc_feature 75: r=a or g
  misc_feature 84: k=g or t
  misc_feature 105: n=a, g, c or t
  misc_feature 160: m=a or c
  misc_feature 251: w=a or t
  misc_feature 265: w=a or t
akgcggcctgttccacgccaggatcagttttgcttcgcagatgggccgwggtggtgagagrragcaatcagtatrgaaatggakaaatggcttaccatgcatgtncttctccccaggagggaggtcgtggtgcaggcgagcagacgccagactcctggamacttgccgcctgcgttatggaggcttagctaataaccttgcaggggtcttcaggcttttccactggctcacctttaggcttctgacacttwtacctacgattgawaaaagacgagattccatgagactagaaatgtaggagcatctcagaccttcacagaacgctctgttagaagatgagaacataacgttgcttgtgagaagtgaagccagctggacttc

SEQ ID NO: 35348 - DNA, 132 bp, Homo sapiens
caatatttttttaattaatgaaattttttttaaaggagcagtccaaagatggtgacaagtcttttttcttttactttcaaggcagttttaggaagcattccctgtctatcttccaaatatgatctggatttt

SEQ ID NO: 35349 - DNA, 271 bp, Homo sapiens
actgacagagtgagactccatctcaaaaaaaaagagagagagagagagaattaagtgctggctgttttattatgggcaagaaaaaaatggtttacaaatgacacatcctttttttttcttcttgagacaagttctcggtctgtcacccaggctggagtgcagtggcgcgatcacggttcactgcaacctcgacctcctgggctcaaatgatctcccgcctcagtcccctgagtagctgggactgcaggctggcaccaccatgcgcggctct

SEQ ID NO: 35350 - DNA, 250 bp, Homo sapiens
  misc_feature 67: y=c or t
  misc_feature 69: y=c or t
  misc_feature 70: y=c or t
  misc_feature 71: y=c or t
  misc_feature 150: m=a or c
  misc_feature 192: m=a or c
ttttcacagaagttgatggcaattcttcacatgtaaacagtgccagtgcacagaacctttatatatytyyycgaagccagtactgtgctctgcatataacaaagctgcttcaaggatgagacctttttctaaaagcatgtaatgtgagamgccggcctgccttattttcttttttcttttttaatgattaamaatagtttgtggcaaggcacggtggctcaggcctgtaattctagcactttgggaggcc

SEQ ID NO: 35351 - DNA, 277 bp, Homo sapiens
  misc_feature 245: r=a or g
tttggaaacaaggtgtgattatgctatactataaccagcccttaatattttttgtctgtaaatatgttgttacccattttattggctttatagtattcacctgtctttatcaaaccccaattttgtcaaatattaaaaattttgccattataaacacttaccttgatggccccttttcagtgtgtctgatttatttatttattgttcatttcagagataatgtatcaattgcttttgcatataaragatttttacattacagataaagccggcctca

SEQ ID NO: 35352 - DNA, 265 bp, Homo sapiens
  misc_feature 239: v=a or c or g
cctgcccacaaggaatttgcattctaattagattatgacagtatggcccagattccatttcagatgtgccagttcatgtgcattttccattttagttttctgaaacagaaacttcttgttctttaaagttcttgttcttcacaagttgttttatactgaggaaagaaaaaaacccagaacattgggttcagacctctccagagatgacagtactgcattatatgaagaaatagaaagavaagagtattatgagtttgcatgcata

SEQ ID NO: 35353 - DNA, 391 bp, Homo sapiens
  misc_feature 70: r=a or g
  misc_feature 76: r=a or g
acagcccaaaatggccgcagaggtgtattttggcgatctagagctcttcgagccgttcgaccacccagargagtcrattccgaagcccgttcacactcgcttcaaggacgacgacggcgacgaggaggacgaaaatggggtcggcgacgcggactacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcaga

SEQ ID NO: 35354 - DNA, 203 bp, Homo sapiens
tgtgatctcatctctgcatgtgactacttcaccagcatgatcatgaatgaatttgtctcctttagacaagtatgtttctgttttgactgtcactgccaggtggtgaggaagcaaagagttaagaaataaacaggcaggtctgaggaaagtgatttagaaaaatattttgatttatttaaactttaaactacagagtagaaggt

SEQ ID NO: 35355 - DNA, 167 bp, Homo sapiens
tacaaaaatatcactgaagaacaacttagaccatttgttggctagccttctatttgaagagtatatttcatatagttcacaggaagaaatggattctaataaagtgtctttgcttaatgaacaatttcttccactcattagacttttagaaagcaaatacccccctc

SEQ ID NO: 35356 - DNA, 297 bp, Homo sapiens
  misc_feature 252: r=a or g
taaatcgccaaagtgaaagtgaataaaaggaaatttaaatgtctgtatgtgaagaggtagcaatgtagacaaaaatgtttgggatggggagatgttggccagaaaaacttcatgccaacaagcataatgctttcaggagggctcaaaaggaagttacttgatgactaaactattgctcacaatttgttttgggcttataggattcggaggtgcaggggcagaatgatgcgatacttttcctcatctattatragggtcacagcccataacaaaagacaggttaacaagagaagagtg

SEQ ID NO: 35357 - DNA, 172 bp, Homo sapiens
  misc_feature 53: n=a, g, c or t
  misc_feature 54: v=a or c or g
  misc_feature 70: r=a or g
  misc_feature 74: m=a or c
  misc_feature 80: m=a or c
  misc_feature 84: m=a or c
  misc_feature 116: m=a or c
cccccttccttaatgctctgggttctggagacagaccacgtctgttgggagtnvtctgtgcccacgcctrgcamagagcmtggmaaagagtaagcgctcaaggaagatctgtgaamttgatgcatgctaaaaggaagccccgcgctctgccggggccctggaactcaggcca

SEQ ID NO: 35358 - DNA, 383 bp, Homo sapiens
  misc_feature 269: s=g or c
  misc_feature 354: s=g or c
tcaagagttattctgaccccttcagagcagttatattatttatttgaaatcagttttgcctacttttgagtttcatattattattcttaaagatttacttatgttgtgaatatcaatatttccccccactgctgtaaagcagcagtccccaacctttttggcactaggggccggtttcctggaagaggtggggatgggatggtttcgggatgaaactgttccacctcagatcaccaggcattagttagagtctcataaggattgcgcasctagatccctcccacgcggagatcacaatagggtttgtgctcatatgagaatctaatgccaccgctgatctgacaggaggcggastcagatggtaatgtgagcgatgggaagca

SEQ ID NO: 35359 - DNA, 236 bp, Homo sapiens
  misc_feature 95: k=g or t
  misc_feature 191: b=c or g or t
  misc_feature 192: s=g or c
ccctgtgatgacggtgtaaagacctcgagggagggaggattttccaatggcagcaaacagtgtatgatcttgctcatgacctgctcagaagtgakgctcaggaagaccacggttgtgaatgatggtggctgacctgactcagagcataacccggcccacaagtccctcaacatactggccatcttgtaatbsctgttcctacccaatttaatgaatagtatacctcatttactgcc

SEQ ID NO: 35360 - DNA, 313 bp, Homo sapiens
agcagcaactttcaccccgcctggcagcccgctgagagcgagagaaaaccacgtgcaccaaactttaggggagggaaaatgggaacgtggggagaagacgtgaggcggcagatctgaaaaagatggtcattccggactcctgacgccgccagtcccgcggtgagatgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcaac

SEQ ID NO: 35361 - DNA, 286 bp, Homo sapiens
  misc_feature 2: m=a or c
  misc_feature 32: m=a or c
  misc_feature 160: m=a or c
  misc_feature 203: m=a or c
amataaatcatgggtagataagtgtaatagamatacactggtatagtccatgatttttgtcagttagtctaccttaatgttaaaatccttttggtatgttagcagttatattcttaatggaatttagttgttaaagtaagatgaaactgctttatattamactctagtctataacagtgatctaatcaagttccaagatagamtcatctgcttattagccaaggcaatcaattagttcaatcaggaattttatgtctgatgggacagaatagtatccaccctccaa

SEQ ID NO: 35362 - DNA, 172 bp, Homo sapiens
cagcttgttccagtagttttctattcatggggaaaaaaaggttttggggggcttttgaggacaatttttaaagttaaatttcttatttggaaaattgttctgaatttgatatttaggagtggccactccaatcttagtgaatttgctcatctcttccagtaatcagccctgc

SEQ ID NO: 35363 - DNA, 150 bp, Homo sapiens
tagtaggagaaatagccaaagttgaggattttatgtatgttttcctgtttacctggaaaatagcaattaattggattttttggtaaagattgccttctgtataatgtttggattatataaaattgcaaaaatgataacagcccgcttccc

SEQ ID NO: 35364 - DNA, 194 bp, Homo sapiens
  misc_feature 164: h=a or c or t
aagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaahataaataagaataactcagaaactcaaaag

SEQ ID NO: 35365 - DNA, 258 bp, Homo sapiens
cacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaa

SEQ ID NO: 35366 - DNA, 258 bp, Homo sapiens
cttaggttgggctgctgaaacaaaataccacagcctgagtgacttaaacaacgacaatttatctctcactgttctgaggtctgagttgattctttgtgaaggccctttcctagcttgcagatggctaccttcctgctatgtcttcacatggcaaagagagagctagctttctggtcttttcttataagggaccagtcccatcatgcccatcatgaagactcgatctgctaggatctcaactaaacctaactatcaccc

SEQ ID NO: 35367 - DNA, 351 bp, Homo sapiens
  misc_feature 54: k=g or t
  misc_feature 68: k=g or t
taataatatctaaaaagctaaattttaaataccagctttacataaatgattgtkgactctggtctgtktctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgca

SEQ ID NO: 35368 - DNA, 272 bp, Homo sapiens
  misc_feature 210: r=a or g
tttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataargtgaattattttctctctcaatcatgccatagtggagacttttgtttgtgagtaagtaacgg

SEQ ID NO: 35369 - DNA, 173 bp, Homo sapiens
cccaagtagctaggattacaggcatgtgccaccacgcccggctaattttgtatttttagtagagacgggggtttcttcatgttggtgaggttggtctcgaactcctgacctcaggtgattcatccgcttcggcatcccaaagtgttgggattacagccgtgagccaccacgcc

SEQ ID NO: 35370 - DNA, 122 bp, Homo sapiens
  misc_feature 92: d=a or g or t
tgatttaaaaaataaatgtgtgctttcatagtattatgctgtgttttttagtaattagtttttgcattcttatggatgggcagttgattgadagcagcagagaagacagaagagagcagccg

SEQ ID NO: 35371 - DNA, 245 bp, Homo sapiens
  misc_feature 2: y=c or t
  misc_feature 32: s=g or c
  misc_feature 33: k=g or t
  misc_feature 34: n=a, g, c or t
  misc_feature 35: v=a or c or g
tycaatgaaacacaggacttaagaggcaggcsknvtgctatgatcgtagcatccaataagcagacagcagacactatcttactctaaagaagctctcagaggagcttctttaccacctaatgtggtatcagggacagttgaacagggagtctgtgagggacctctgaggttgtgggttgagagggtcgatgttactgtgacccctgcacgccaggtcctggggaccagcttctgccctgggacta

SEQ ID NO: 35372 - DNA, 151 bp, Homo sapiens
  misc_feature 95: k=g or t
  misc_feature 125: w=a or t
attgataagtcctggagccaagtgtcagagagggacagttcgctgtgggctggaaaaggcatcctacggctggacacttgagttgaccgtttaakaatatgttagattaggatcaagagcaggawatggaacattccagatggagaggttg

SEQ ID NO: 35373 - DNA, 356 bp, Homo sapiens
  misc_feature 319: w=a or t
tttacttagtaatttatttacctcaatgtgggctcatagatatttgatgccttgggttataattgaatataattttcttttgttcagattattctagctttggccattgggaactcttttacttgactacctggtcccttttatatatatccatcagtgtgtggttttttttgtttgtttgggttttaacacttccatactttctggcactacaagatgctcctggcactgcatgtatattttgtgccctactcctagaattaggcatttgtccaaggagctgtggttccttttattggagaatgagattagaaaccawgacctgaacactagatgtgcttgctgttaccgggccc

SEQ ID NO: 35374 - DNA, 382 bp, Homo sapiens
taggaaggagccagaaagtattcatactgctactccttatgagatagccaagaagcatcatgtcagtaactgggagtggagagggagttttgttttgaaactatgcaggtatttttcagcatccatttgtacattagtatggttctacaggaccccagctgtggaagtaacaaatttcttctccctccagactcttggatgactacctagatccccagcttaccggttagtttcctccacaggcttccatgagctcagtgtcccaagacagcaaaaatctggtataccctgtagaagcaggggggtagcaaatttaggctctcttcgaaattacttgtacaatacgagtgccttcgcagcttagccccaaagtgctacttat

SEQ ID NO: 35375 - DNA, 200 bp, Homo sapiens
taacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatac

SEQ ID NO: 35376 - DNA, 115 bp, Homo sapiens
  misc_feature 65: w=a or t
tctgtatttattgtgctgtgtctggtcctaagtggagccaattaaacaagtttcatatgtatttwtccagtgttgaatctcacacactgtactttgaaaatttccttccatccaa

SEQ ID NO: 35377 - DNA, 53 bp, Homo sapiens
  misc_feature 48: y=c or t
ttatgtctcaagtaaaatggctgagcattgcagagaaaaaaaaaaagycccca

SEQ ID NO: 35378 - DNA, 164 bp, Homo sapiens
agaaaacaaaaataaaaaataaggctgggcgtggtggctcacagctgtaatcccagcaccttgggaagctgaggcgggcggatcacctgaggtcaggagtttgagaccagcctagccaacatggtgaaaccctgtctctactaaaaattcaaaaattgggcatt

SEQ ID NO: 35379 - DNA, 153 bp, Homo sapiens
  misc_feature 38: k=g or t
taaaaagtcaggaaacaacaggtgctggagaggatgtkgagaaataggaacacttttacactgttggtggactgtaaactagttcaaccactgtggaagtcagtgtggcgattcctcagggatctagaactagaaataccatttgacccagct

SEQ ID NO: 35380 - DNA, 180 bp, Homo sapiens
aaacaatatcgaggcacgtagttttgttgttgttgttgtccatgaaaagagtatattcttttattgttttttgtccatacatgttaagtttcaactttcaataataaaattcaataaatttgattccttcatcataaaaacttgctttacacattatttacatgttgccaaagtccataa

SEQ ID NO: 35381 - DNA, 79 bp, Homo sapiens
atccgggctagagaggaaaagagaaaagtttcatttaaacctgaactaaaaactttcaccatgaaagcacacaacatac

SEQ ID NO: 35382 - DNA, 192 bp, Homo sapiens
  misc_feature 66: r=a or g
  misc_feature 171: w=a or t
caacatttaaagctttatcggttattgttttagatttgagatttttgtttttaagtatctataagrtctttagaagtgagataaatttttcgctggttaaaaaaaatcaaactttcctctgcagtgtttttgccaagttttgtcacacttcatgtgtatgcattaactatwcttcttagtgttactgcaaaa

SEQ ID NO: 35383 - DNA, 265 bp, Homo sapiens
actatggcgacggtgggggctccgcggcacttctgccgctgcgcctgcttctgcaccgataacttgtacgtggcgcgctatgggctgcacgtgcgcttccgaggcgagcagcagctgcgccgggactacggcccggtgagtggccgctgtcgtccctacggagcagtgggcagagaggggtagtggaggagggaagttcgtccccagggtcgtttgctttgcgcacgccgcgcaccgtatcttcaaatacaagaatgacggcctt

SEQ ID NO: 35384 - DNA, 156 bp, Homo sapiens
aatctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggcca

SEQ ID NO: 35385 - DNA, 299 bp, Homo sapiens
tatttgggtttggtgctattcgtattcagggtcttggaatgcaactcccacagataagggggtgctgctggagtgaaatactgtgatataacctttttttcaggaaatgaagggagaagatgtgtacgtgtgtgggagaggtataagagacctaggttgccatattctatcacagaaaatgcataataactaaatctggaaaatgatgaatagctgtacaaccatattatttagcaataggaggtaaatacaggtagaagcagaagaaagaatgggcaggggttacctctatggagtag

SEQ ID NO: 35386 - DNA, 355 bp, Homo sapiens
ttgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggtt

SEQ ID NO: 35387 - DNA, 246 bp, Homo sapiens
  misc_feature 148: b=c or g or t
caggtttttatcttgtcttaaatttctttctaggaaaaaacccttccctgccaaaggtgactgtgttttctgccgccgaagagggcccggtccctccaggctcagtgtggcttctccctgacccccgccctagaacttttgccagtgbcttttctgaaactcctgtgtcccgggccccccaggcggagaaggatatgccggattctgcctggggctgggctctaggagaccccaaatttgacactc

SEQ ID NO: 35388 - DNA, 257 bp, Homo sapiens
agtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctaa

SEQ ID NO: 35389 - DNA, 144 bp, Homo sapiens
  misc_feature 94: v=a or c or g
aaaattagcctaatatataatagatatattatgacgcaaaacttttatttttgaaaaggcagaataattttcagtgaagtaagtgactaaagavaaaaactatattattgtttatgcaagggtcttacaggaaagggtcttttt

SEQ ID NO: 35390 - DNA, 393 bp, Homo sapiens
  misc_feature 278: r=a or g
aaccaatttttatccttttacccttttatcaattccatgcagtgactgaatgctccccacaatgcctgccacgtgtggcatgaatattgcatagtgaggaacttaatttatgggaatcaagctgatgaaaactctcaaaaccaggatgaggccgggagcagtggctcacaccacgcctctaatcccaacactttgggaggccaaggcaggaggatcacttgagcccagtagttcaagaccagcctgggaaacttggcaagacccgatctctacaaaaratcaaaaaattagcaggatgtagtgttgtgtgcctgtggtcccagctacttgaaaggccgcagcaggaggattacttgagcccaggagttcaaggctgcagtgagttatgatcat

SEQ ID NO: 35391 - DNA, 182 bp, Homo sapiens
ttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgccagc

SEQ ID NO: 35392 - DNA, 310 bp, Homo sapiens
  misc_feature 126: r=a or g
  misc_feature 192: k=g or t
  misc_feature 203: r=a or g
gacctgttccaatttgatctacaatttttttctgtgtttttcaccagattgtactcctaaaacttaacaggccatcacaagcaattgtcttttgtttacaagattgatttaatatgagaggatacraaatgtcatcgttatcctctcttatgaacaactgtagtcaaaataaggtggcacaatttaattgtkttgtatcagaratacactgacccaccttttattgagtcctgccacatgttaggtaccatgctctgctgtggagacagagcagtgaccccaaggagctcacggtccctgaaggaggtgc

SEQ ID NO: 35393 - DNA, 112 bp, Homo sapiens
  misc_feature 67: r=a or g
ttcatgaaatgatgagttctagtgctcagcatcaggcctggcagtagcagttgccctgtgagtggargctgctgctctctacctcagcagcatcagtcagcatgttcgtccc

SEQ ID NO: 35394 - DNA, 207 bp, Homo sapiens
caaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacct

SEQ ID NO: 35395 - DNA, 334 bp, Homo sapiens
  misc_feature 75: m=a or c
  misc_feature 265: r=a or g
  misc_feature 267: r=a or g
  misc_feature 289: r=a or g
aatattaatgaaattaatcaagagtgattacaataatattaccaggatagagtgaaacattatttaatgataaamagtacaattcaccaagaaaagtagcacttctaattatgtatgaatcaaacaatagagctgtaaaatacatgaagcaaaaactgacaaagctgaaaagaaaaataggaaattacactattacagtggaaaactttaacatttctctctcagcaaatgatatagaaattaggcataaatctgcaatgataargractcaacacatgattaaccaaraggatctgatcaacagtagacaatgaataatacacagtattttca

SEQ ID NO: 35396 - DNA, 190 bp, Homo sapiens
atatggatggccagttgtcccaacatttattgaatgtctatcctgatgcaaaatgttacttttatcataagctaaatatgtatatgtctgtctggatgtatatatgtgtatatagagtatgtgtatatttgtatactattcctcacgacctctcagttccaccctaaccacagcagtttgtgcacggact

SEQ ID NO: 35397 - DNA, 256 bp, Homo sapiens
cataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaaggcgttcttaaatttggtgcagcaaaa

SEQ ID NO: 35398 - DNA, 206 bp, Homo sapiens
  misc_feature 157: b=c or g or t
taaaaatgtgagttggggctgggtgcagtggctcacacctgtaatcccagcactttgggaggccaaggtgggcggatcacctgaggtcgggagttcgggaccagcttggccaacatggcaaagccccgtctctgctaaaaatatatatatataagtbagccgggcgtggtggcacatacctgtgatcccagctactcgggaggccc

SEQ ID NO: 35399 - DNA, 136 bp, Homo sapiens
cattatataatgtccttctttgtcttttttaactgctgtttctttaaagtttgtgggtttttttgtctgatataagaatagctactactactcatctttggtgtccattttcatagaatatctttttccaccccat

SEQ ID NO: 35400 - DNA, 220 bp, Homo sapiens
caagtgcacacatatattgtctttggtacgaagatccaagtgagcaggtcaatagattagggagattcccacaaaattatcttattgtaataagtgaggagtctctgggaatccttttgttctggcaatctattgctatgtaacaaatgaccccaaaacttagtggtttcagataatgacaaaatttattttacttaagtttctgcaatctatgtgagtc

SEQ ID NO: 35401 - DNA, 372 bp, Homo sapiens
  misc_feature 57: h=a or c or t
  misc_feature 220: r=a or g
  misc_feature 227: r=a or g
  misc_feature 228: m=a or c
  misc_feature 255: k=g or t
  misc_feature 256: m=a or c
  misc_feature 257: h=a or c or t
  misc_feature 258: n=a, g, c or t
agaaaatagttacaggaaaggtggtgatgctacaaagtttgtaggataatgcatgghagacttgcgcaggaggcatcttgatgtggatgttagaaccttagaggaaatcacgatagaattattgagtgttagaaccggagaatgttataactgttataaaccttataggtttttatatcattggttttctgactgggttcagtgtaaccttgggttacarggagatrmcttggggccttacctgggagtgtgackmhnaattgttggggacccagttctgcttccttaagtattatgcctagttcagctgatcaaaacagctccacttttatctcttttgaatatatgtatagggttctatttcatattttt

SEQ ID NO: 35402 - DNA, 307 bp, Homo sapiens
cagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacat

SEQ ID NO: 35403 - DNA, 383 bp, Homo sapiens
  misc_feature 373: v=a or c or g
tctgttctttggtcaaatgaccatacatgatatgggacaaattgtttcattttgtttgttttttaataagggaacttggtaaagtagttccagtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaagatcctaggaagttatctgtaaccagtctcttgtctcaggctcttcaccttgttaccaatcctcgtaagtatgtaaaggaaacatatttttvaagaagctta

SEQ ID NO: 35404 - DNA, 303 bp, Homo sapiens
caagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctct

SEQ ID NO: 35405 - DNA, 243 bp, Homo sapiens
aaaaatttcatagtttcacgtcttaggtttaagcccttaatccatcttgagttgatttttgtatacggtgagagataggatctagtttcattctcctatgtgtggctagccaattatctcagcaccatttgttgaaaaggttatccttttccccactttatgtttttgtttgctttgttgaagatcagttggctgtcctttgtgatttacgctttaaagaggttctgtgcaaaaatcacaagc

SEQ ID NO: 35406 - DNA, 188 bp, Homo sapiens
tctcccctcctcctcattacccagaactaacgctattagtttggacttttggtgtctgttatctgacccctgggcctgcacagcccttctccatgactcttcagaccttttgtctcttttgtcgtcaagaaggattcttttttcttctgtttctttttctactaagatttgaattttaagaccccgcc

SEQ ID NO: 35407 - DNA, 130 bp, Homo sapiens
accgagcccaggagccggggacggtgcgccagtgccccctccgcgagccccaaccagtagacggttccctgtctcccgcgccccaatttcgattttcaaacgcaactcctacaggattctgagaccccat

SEQ ID NO: 35408 - DNA, 182 bp, Homo sapiens
  misc_feature 13: n=a, g, c or t
cactgcaagtgantgcttctttgaagcctcatgttttgtcttagatcgtggagatttttctttctgcttcataatatagccgtgtttgctctaatagaaaaataataactcccctgagaaaatctttggatgaaattagtaacctagggagatagacttcaggctctctggctgtctgtagc

SEQ ID NO: 35409 - DNA, 255 bp, Homo sapiens
caaaatctactcttctggctattttcaaatatataatatgttattgttaactatactcatcctactatgcaataggacaccagaacttattcctgggttctacatctgttaagccaaccaaagattggaaatattgggaaaaaaaattgcgtctgtactgaacatgtacagacttttttcttgtccttattccttacacaatatagtacaataactatttgcatgacatttacatcggatattatgagtgatcta

SEQ ID NO: 35410 - DNA, 183 bp, Homo sapiens
agacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtactg

SEQ ID NO: 35411 - DNA, 136 bp, Homo sapiens
tgattgccaaggccacagccaaagaagcaggctgtcgatttattaaccttcagccttcgacactgaccgataagtggtatggagaatctcagaaattggctgctgctgtcttctcccttgccataaagctacaacc

SEQ ID NO: 35412 - DNA, 309 bp, Homo sapiens
ggatgaaaatagctccgggtgagctctggaacagctgaaaaagctggagcaaccaagcagggcctacaagccgaggagggctgtttaaaggcgcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccgga

SEQ ID NO: 35413 - DNA, 394 bp, Homo sapiens
tcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaata

SEQ ID NO: 35414 - DNA, 289 bp, Homo sapiens
  misc_feature 192: s=g or c
aagtcagcgcggcagccgcaggagcctcagaatagagagaactgcctgctccggattctgatccgtgtggcgagtgaggccacgagaaggtggacccggccaagcgaatttagcagtcggagcgagaacccaagggctcatcacccccgccgcgccttgcgccctccagaagaagctacttgacccgcgcasagaagggtaaccatgtggacgccgccccttcctttgggccctcccagctctgagctttaaagtatccgcggcccggcctcggagcttcgcgcctccc

SEQ ID NO: 35415 - DNA, 205 bp, Homo sapiens
attgaggaggcctgaggctggaggatcccttgaacctaggagtttgaggccagcctggacaacaatgtgagattgtggctccaaaaaaataataaaaaataggctgctctgcctatggagtagccattcttttattcctttacttttttaataaacttgcttttactttatggaaaaaataaatttttaaatgactagatgaagc

SEQ ID NO: 35416 - DNA, 138 bp, Homo sapiens
aattttgcatgttttctggcatgaattaagacacttatacttgtatatatgagtgtacagtttgttctcacactgtcaccatagcgacaggtcctggctcccagtggttcatcctgcctgcccctctctcccagcccc

SEQ ID NO: 35417 - DNA, 242 bp, Homo sapiens
atgtgtcttttatcacatgcatttgtaacttgcagaaatttgaagggatcttggtaacattttggactaataaaaccatctctgcttattatgcccctttgctagtttgtgaaaagtaggccataaattctacaagaaccacagacaagatactgtaaccccatagaaaactctgtctacagggacaatgctcccctctctatactgaaatgagtcatagagtgcctggctagcaaaagaac

SEQ ID NO: 35418 - DNA, 353 bp, Homo sapiens
  misc_feature 51: k=g or t
  misc_feature 308: y=c or t
  misc_feature 309: b=c or g or t
  misc_feature 323: m=a or c
  misc_feature 326: m=a or c
cctataggacatcgaggtgaaggggacccaagtggtattcccatatttatkggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtybgaaggaaaactgamgamaagacttggcttagaacaaatgaggag

SEQ ID NO: 35419 - DNA, 180 bp, Homo sapiens
cacttgccctagcaaccttgtaattatatttaccagtgattctacttcattttccatactggaaccaggcatctgttttaaagaatgaaaatttctttcttgcttcaaattttctgttagtaccctgtttctcattgcctttggggctctagcctcaaatgttttattagcctcattgcc

SEQ ID NO: 35420 - DNA, 87 bp, Homo sapiens
aattcattttctttcagtccttggtggagatgctttaaaatcattgcatttgtttttgtgaaaggaagttctgagcttttttttttt

SEQ ID NO: 35421 - DNA, 124 bp, Homo sapiens
cctaaatactcctaaataatatttctaatcagccattatgctggggcatctctgatcccagtaggtacctctgaaatataccaggtgtctggagttagaagcccatagccctttcccagcggat

SEQ ID NO: 35422 - DNA, 261 bp, Homo sapiens
  misc_feature 210: m=a or c
  misc_feature 211: d=a or g or t
cttaacatttggctagtagtttattcacccctctttttggtgaatacaaagcagtaaaaccatgttttcaaattattatttggttatgcaggttaatacttatatggattattttagaagtacaggcttcatgttgagttttgtaaagagctttctctttgccaaaacattttcagacttcaaagaaccattgtgtaaaaactcttttamdcaatgtatcttaaatagttttgatcattttatttaaataaagaagcttat

SEQ ID NO: 35423 - DNA, 54 bp, Homo sapiens
  misc_feature 2: s=g or c
  misc_feature 11: y=c or t
  misc_feature 23: s=g or c
  misc_feature 31: y=c or t
  misc_feature 51: s=g or c
asgcttaccayctgcacccggasagctgtgycaccatgtgggtcccggttstct

SEQ ID NO: 35424 - DNA, 147 bp, Homo sapiens
cttttcaactgtcaactcttctgcaggcttcagatccaagcagttggttaataataaagatactacatcctttgaagacataagtccacaaggtgttagtgatgattctagtacgggatcaagagttcatgcttcaagaccagcccc

SEQ ID NO: 35425 - DNA, 191 bp, Homo sapiens
  misc_feature 47: y=c or t
  misc_feature 73: m=a or c
  misc_feature 89: m=a or c
  misc_feature 121: m=a or c
  misc_feature 139: m=a or c
  misc_feature 178: m=a or c
agtgttcatagtcgtttcgttttgataattgttgaaccaattttgtytttaaaacctttagactctgaaagtmatattttgactaagamtgtaaatatttccaaactaaattactcgggamgtaaacgctttttttaamagtatttttactggttttataccaatattatatgcagamatcacaggatgtc

SEQ ID NO: 35426 - DNA, 371 bp, Homo sapiens
  misc_feature 253: d=a or g or t
  misc_feature 332: r=a or g
ttttcactctttcttactggttttccccactggttagtacaaaggctgggggaggttactagatatttagcaaagatatgggaagatggtaaaatatctttatgttgagaatggctcagccacattctcagaagtgaaagaatgacacggtgttgtcaggttatacctcgataggctatgtatgtctgtgggcatcctgagagagaggaagtgtgccctgcatcttgaggcttgggtctgtccaataattttdagcccctgggctctgctacccagtgcacttatacacacacacacatgagtgtgcacatacatacaccccacacacagaragtgacatgacatggctgccacacccatcagccacattt

SEQ ID NO: 35427 - DNA, 147 bp, Homo sapiens
caaagaattatcccccaagaaagacttctggacccagaatctgccagaatctctggcaaattcttttttaaaaattttaagaagcaaattatccctatgttacataaattgttctagaacaatggagaaaaagatagaaagcagccc

SEQ ID NO: 35428 - DNA, 159 bp, Homo sapiens
aagggttttaaaggccaggtgcaatggctcacacctgtaatcccagcactttgggaggccgaggtgggcggatcatttgacatcaggagttcaagaccagcctggccaacatggcaaaacactgtctctatattaaaagtaccaaaattagctgggcaa

SEQ ID NO: 35429 - DNA, 285 bp, Homo sapiens
gaatctcacgagagaagaaaaccagccacataaaggatttgaaagctcaacttgctttcccactctgttatccctggagttggcttggattcaccctgaagccttccccctcccggggaaagttgcttcacgttgcagctcagcaggtttgtccagctacataggctccagaaaacaagaagcaagactggaaagctggggatgattgtacgccctcgcctgaatcttacgtggttcctccttcttccacctggccagtgcagagccgtgggtgccacgtggccc

SEQ ID NO: 35430 - DNA, 279 bp, Homo sapiens
  misc_feature 107: r=a or g
tgactatttaatcctttctacttgtcgctaaatataattgttttagtcttatggcatgatgatagcatatgtgttcaggtttatagctgttgtgtttaaaaattgaraaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatat

SEQ ID NO: 35431 - DNA, 65 bp, Homo sapiens
  misc_feature 45: m=a or c
  misc_feature 46: m=a or c
cattcggttttatttttttaaccactgttattacaatctgttaammtttctttccccccatctct

SEQ ID NO: 35432 - DNA, 116 bp, Homo sapiens
  misc_feature 36: b=c or g or t
cttgtctctaaacaaaaatttaaaaatacaaaagcbgccgggcgcagtggctcacgcctggtaatcccagcactttggggggtgccgaggcgggcggatcacgaggtcaggagttt

SEQ ID NO: 35433 - DNA, 199 bp, Homo sapiens
ctgttcaaaaggaattcttgactggaaataatgagcatccgaaaaggcatttcaagaaacaaataccaccgcccccaaatggaaggctataatgttcttattgttagcaagaaaaataacatggctattatagctaaattaactaaatggcctgccacctgagaatctattgtttatggcaggttcagtgacagacaca

SEQ ID NO: 35434 - DNA, 237 bp, Homo sapiens
  misc_feature 41: k=g or t
  misc_feature 42: k=g or t
  misc_feature 52: s=g or c
  misc_feature 53: s=g or c
acaaggtgtctcatctgaaaagaaacctgagccccagggakkcggcgcggassaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagaga

SEQ ID NO: 35435 - DNA, 100 bp, Homo sapiens
  misc_feature 71: k=g or t
cattatacccattggatgagttgattacagtttattctaatttcatagcctgacaaaatgtttattatatktatttttatatgtaaaaatttgagtggtg

SEQ ID NO: 35436 - DNA, 101 bp, Homo sapiens
agtccaaaagcggttcctcaagagcttgattttttatgctacagctacactaattgttttttatggactcaagactgcgatcaggaatggagactggcagc

SEQ ID NO: 35437 - DNA, 302 bp, Homo sapiens
tcctttgcaggtttctcttcttttggccactgatgttgggattcttcgcagccatccctggccctctttctttcctctattttcatggtgttttcttctaagcccaaagtttaagtaactttgccatgataacccaagtttatgtctccagctcagacttctttgacccatatatccagctgcctattcaacattgccatgcaaatgtcaaactcattatattcaaactgaatttgtgattttacccctgggacctgaccctcttccaatgatctctttctcatgattagtaccactcacca

SEQ ID NO: 35438 - DNA, 135 bp, Homo sapiens
aagaatacagtctgtgacaaagctcaaactgcagacatgttcagatcagcattattagaactgcaacaggcaaaactaaaaagaaactagaaatagcctaaatgcccagccacaaatggataaataagtacaggg

SEQ ID NO: 35439 - DNA, 159 bp, Homo sapiens
tacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgct

SEQ ID NO: 35440 - DNA, 222 bp, Homo sapiens
tgacattatcctgtggttacatgaatacctcagttaacaagcccagttggagttgacccaggtgctaggttagccaagcttcccaagtaattgaggattatgctgggaacacagctcactgatccctccctctgtgaaaagaggggcatagtctgaaattccttgtctcaggagcactgttctttttagttaacctttcatttatgtatatttatgcagacc

SEQ ID NO: 35441 - DNA, 284 bp, Homo sapiens
  misc_feature 185: r=a or g
  misc_feature 215: r=a or g
  misc_feature 233: r=a or g
  misc_feature 242: r=a or g
  misc_feature 263: n=a, g, c or t
tagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaraatgacacatatttaaacacttagaaaatraagttaacacttactgargtgctagtrctaaactgtgctagtactaanagaaaacaggttggaacatac

SEQ ID NO: 35442 - DNA, 390 bp, Homo sapiens
  misc_feature 81: k=g or t
tctttggagaagtatctattcaagtcctgtctctgtttttgaattgggttttgtagttcagttcttttttctctttttgtkttttgtttgtctgtttgtttgtttgtttgtttttgagatggagtctccctctgttgcccaggctggagtgcagcagcgagatcttggctcactgtagcctctgcctcctgggttcaagtgattctcctgcctcagcctcctgagtagctaggagtacaggtgcgtgccaccacacctggctaatttttgtatttttaatagagacggggtttcaccatgttggtgaggctggtctcaaactcctgacatcgtaatctgcccgcctcggcctccccaagtgctgggattataggcatgagcactgcgcct

SEQ ID NO: 35443 - DNA, 201 bp, Homo sapiens
ttattttaggtattgtattttttagttctagagttgcaatttgattttttatagtttttatttctcttttgagatgccctatctttgcattcgttataaacatattttcctttaagacattgaaaatagctacaaccactactttaaaattattgtcctttcagttccaagtttgctgagagtttttatcatgaatggacc

SEQ ID NO: 35444 - DNA, 242 bp, Homo sapiens
tccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagcta

SEQ ID NO: 35445 - DNA, 343 bp, Homo sapiens
  misc_feature 274: k=g or t
  misc_feature 293: k=g or t
  misc_feature 297: r=a or g
cagtacttggtacagaataggccccattaaatgaatgttactgatgtagtaggtgtcatttttttttaagtgttatctttcggatcctcataagcactatgtgaggcagctgtcaccctgattttacagaaaggtaactgcagcccagcacagtgatgtgacttagcccaaggtcactccacacattacctcatcacctacttcatttgcagagaaaataaaagctgtcacaggagagctcctgcggccactaattcccaagcatctgcactgktcttgtctcctctcctgtkacartgggaagtttgcctctgtccacccaaagcccctagcgctcatcccc

SEQ ID NO: 35446 - DNA, 82 bp, Homo sapiens
tcaaaagacccaaatgcttatacttctctctcccttcttctctctctgacacacacacacacacacacacacacacacacac

SEQ ID NO: 35447 - DNA, 116 bp, Homo sapiens
agtcggggcggcagctgaggcggaggctgacgaggaggcggatcccccggcgtcagatctgccgacaccccaggccatcgagccccaggccatcgtgcagcaggtcccagaccccc

SEQ ID NO: 35448 - DNA, 328 bp, Homo sapiens
attctaagagtgggaagactgaaggcttttctgcaggtaccatgggacctcgccacattgcctggaatcgcctgaccctccctttaccccacaaggagtccccagcttttggagcttcagagttcttgtccaagtctcacacaatcccctgaagagtggtgaaaatactctccaaagtcgctgaaccctgagcacaggaccacatcccaggaactgccacataagaaagggggaatccatgcatggactcaaagtactgaatcagcagctggaaatactaaagtaattcatgacccatagaagcacaagtcaaaaatggtagtctgca

SEQ ID NO: 35449 - DNA, 114 bp, Homo sapiens
tatgatctgtcaccagccaagcaggagccaaagcccttcgaccgcttgcagcaactgctaccagcctcccagtccacacagctgccatgctcaagttcccctcaggagaccaca

SEQ ID NO: 35450 - DNA, 171 bp, Homo sapiens
tcgattacatattttcagagcctctgtttcttgtgcatcaagaaacagtttgtacatttagggtcattatgagaatttgattaacatctaccttgtccagtagctgtcagcttcctgagaggaaagaccacatgccttattgctttccactttctctccaaagccatcagc

SEQ ID NO: 35451 - DNA, 233 bp, Homo sapiens
atttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcacc

SEQ ID NO: 35452 - DNA, 99 bp, Homo sapiens
catactcataaatagcactaaagtgttataacattttcatttacctatttttagttccttcattttaacttaataaaaatcttggattgatattctttt

SEQ ID NO: 35453 - DNA, 132 bp, Homo sapiens
cttatagtaatatatttgttttaagtatttgcccaaagatacaagattctttggtttcagggacagaattggtgcatctaattaaggggatggattagggccggggggatgagtttagagagaggggggcac

SEQ ID NO: 35454 - DNA, 401 bp, Homo sapiens
  misc_feature 70: w=a or t
  misc_feature 181: d=a or g or t
  misc_feature 182: n=a, g, c or t
caatcgttcagtaaatgtttcctgagcatttatcatgtgtcagctactgttggagctctgaggaatggtwctcatgcagtttacattctagtaagagagcaaggcccaataaccaagcactcgtgggagaagaaggatttcagataccacggggtgggcaggcattatagcaggagctaadnagcacagagtgaaagcatgtattctgggattgcattgggacttggaggggatataacgggagtgtaggggtgtggcgttagcacaaggggagcctcaactggcttaataagacatttacctcaatgataggggtaaaccactgtagggttttgtttgtttttttaagaacacacaacaacactaggttttgtaggtttttggaagctctttagtaacat

SEQ ID NO: 35455 - DNA, 160 bp, Homo sapiens
caaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatc

SEQ ID NO: 35456 - DNA, 245 bp, Homo sapiens
  misc_feature 42: y=c or t
  misc_feature 222: m=a or c
  misc_feature 223: m=a or c
actgaggaggtttgaggcgcgcgctctgggcaggaagcctcyctagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatcmmtccgctttctattcacccccga

SEQ ID NO: 35457 - DNA, 374 bp, Homo sapiens
  misc_feature 313: k=g or t
  misc_feature 325: w=a or t
  misc_feature 327: w=a or t
  misc_feature 330: k=g or t
  misc_feature 343: m=a or c
  misc_feature 344: s=g or c
  misc_feature 345: r=a or g
  misc_feature 351: v=a or c or g
tgtaattaaaatatgttaatgttcccctattgcttctgagtttcttatcataggttaaacatttttcagtaaccaagttatatgaggattttttttttctgatatttgtcctgtataatttttaacatttggctgtccagtatgaagaagtgaacttttccctgatttgagatgctgtttttatcgtatactaaattttcacatactattgtggtctctttttggattttctattgtttcattagcctatttgtctgttcgtgtgccaacacaatgttgatttaattatagaggctttacaaaattggctggkcccttttcattwcwctkgtttcatgtttgmsrgatacvcaattttgtaatgaaattgtcta

SEQ ID NO: 35458 - DNA, 226 bp, Homo sapiens
  misc_feature 41: w=a or t
  misc_feature 42: k=g or t
tatacatgatgtctatggctgctttggcttacgacagcagwkctgaatggttgcaacagagtcatatggcccgcaaaccgaaaacatttaccatttgactctaacaaaagcttgttgatcaccattctggtttagttattctaaaccaagtgtggtccttggagcagcaattcagcatcacctcagcatcacgtcgtattgttagaaatataaattcttggacccc

SEQ ID NO: 35459 - DNA, 328 bp, Homo sapiens
  misc_feature 73: m=a or c
  misc_feature 125: m=a or c
  misc_feature 129: h=a or c or t
  misc_feature 218: r=a or g
  misc_feature 258: r=a or g
  misc_feature 294: b=c or g or t
  misc_feature 322: d=a or g or t
ctggtttgcatttcttttaaagagatgatagaggaaaatatagttttttgtaagaatgtttatctctcttaamagataatcttttaattttcttcagataacaagttattattattttttaagamagchagtttcacgggccgggcgcggtggctcacgcctgtaatcccagcactttgggaggccaaggcggcggatcacgaggtcaggagatcgaraccatcctggctaacacggtgaaaccccgtctctactaaraatgcaggaagttagccgggcgcggtggcaggcgcbtgtagtcccagctacttgggaggctgadgcagga

SEQ ID NO: 35460 - DNA, 278 bp, Homo sapiens
cacttcatgtagcagatcttctccataatttgctgatgtaaagcattgtgaagtcagttttactttaatgtgtctgcttcttagcacagcctgaagctgttgaagtgccgttatttccaaatgtattttcagtgataagtggtcatgctgacagaatgtctaaacttattgaaaagtctgtgggtattacatccagttgattataaaatactaatatctggtgactaaggggccagaatctcttgggaataagacactatctatcataaagggccctt

SEQ ID NO: 35461 - DNA, 180 bp, Homo sapiens
cagaacaacaacaaccctcgtgcatttattttgcatgttaaatgggcctcaccaaaaatgcttgctggttttccccagacaccttttttttccaactcggtgtttcctaaagctggtcctccagaatgagaggtttgtaccttgtcaatgactcatcatcctctcatgccagcaccccta

SEQ ID NO: 35462 - DNA, 173 bp, Homo sapiens
agtcaccacatgggttttgattgcctgcctcctcctttacttagaaggaaggaataagaaactctaccttgtttaagccactgttatcataggcctcaactggcagctgaaggcagttcctaactgatagattctaacttgatcttactgtttccttcctcttaccaccaagc

SEQ ID NO: 35463 - DNA, 171 bp, Homo sapiens
gtatccgcgtctccccaaggaaaactgcggctggcggtgcgggaagtgctattagtagttgtttatttgtttgtttgcagaaataattgcttgggtacgaaggtcaaacgagaatgaagcaagtatattatctagtttgtatgtctttaaatagtttctcctccacactaa

SEQ ID NO: 35464 - DNA, 273 bp, Homo sapiens
cgagatgaatgcacacatcacaaaaactttgtcagattgcttctgtctagttttgtgtgaagatatttccttttccaccacaggccttaaagctctccaaatgtccacttgctgattctacaaaaagaatgtttcaaaactgctctatcgaaagttaagttcaactccatgagataaatggcaactccgtgagataaatgacaaataagcttgtcagaatgcttctgcctagttttaatgtgaagatatttccttttccaccataggccgtta

SEQ ID NO: 35465 - DNA, 331 bp, Homo sapiens
  misc_feature 179: k=g or t
  misc_feature 187: s=g or c
  misc_feature 188: m=a or c
  misc_feature 195: d=a or g or t
  misc_feature 229: k=g or t
  misc_feature 230: w=a or t
  misc_feature 304: w=a or t
agatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaakcgcttgtsmttatgtdtgtaatttcagttaaatattttctacagattgckwcacttcccctttcccccaataacaagttcatattcttgtaatgtttactttggtcaacgtggtaatttttggawgaaatgccaaaatgtaagcttctcaca

SEQ ID NO: 35466 - DNA, 113 bp, Homo sapiens
  misc_feature 2: s=g or c
  misc_feature 4: h=a or c or t
  misc_feature 19: r=a or g
  misc_feature 28: s=g or c
  misc_feature 33: m=a or c
  misc_feature 53: w=a or t
  misc_feature 55: r=a or g
  misc_feature 86: m=a or c
  misc_feature 87: d=a or g or t
asahggcagcggggcggcrgcggctgtsgaggmcgcagtccgggtcctggctwcrgcctcagccccaccatggtgaagcttgctgmdctgctggtgctcctggccgctctcct

SEQ ID NO: 35467 - DNA, 284 bp, Homo sapiens
ccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgccat

SEQ ID NO: 35468 - DNA, 236 bp, Homo sapiens
  misc_feature 149: n=a, g, c or t
ccataatggctgtgaaatgagaggagagtggaacaagtgagatattttgtgagattttggaaaactgaaattgtgctgatgtggtttaaacttgatgtagtaagtggtgctctaccattgcacataatgcattcctaaatatatatganaatgtcatacaaaatttcagcatcaaatgggtataaaaacatacagaatttcagtatatcaaaattgatataccatgaggggcaagt

SEQ ID NO: 35469 - DNA, 228 bp, Homo sapiens
  misc_feature 69: r=a or g
  misc_feature 192: n=a, g, c or t
atttcagtacttctttcatgatctagaaaactgaaacctgttctacccacttagagtaagaatgaagtrgaaggaatcctgtagataagaatatataaagtcacaacattaggaaattttttcagaaggcagctatgcaaattcacatggatccaagatattttctattttttgttgctcattgggaaaganaaaaaatctgtaactaaataatccattctggcccat

SEQ ID NO: 35470 - DNA, 353 bp, Homo sapiens
  misc_feature 264: w=a or t
acatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttgaagctgtgttcaggttgaatatctctaatctgaaatttgaaatgctccagaatctgaaactttttcttttctttctttctttttttttwaattaaagttctagggtgcatgtgcacaatgtgcaggtttgttacatcagtatacatgtgccatgttggtttgctgcacccattaactc

SEQ ID NO: 35471 - DNA, 157 bp, Homo sapiens
acaacaataaagcaaaataatatttaaaagaaagaaaaaacaaacagtcgcaataccagaacaccattgtagtcgtttgtgtatgtgtgacttctttactgtgttcatgcagagacaagctttgtaatacctttgtaactactgtacaggtgcgcta

SEQ ID NO: 35472 - DNA, 369 bp, Homo sapiens
tcatgcctttgtcctcctctaattttcaggtatttcccagtttctgatctacagcttcctttgttttttttgttatagctgtgtatctgtttactttcaaacacgaattgtttttgccattcccctggatccggtgaggaagggaaggttttggcaggagtcggatgcctcctctgaggactgaaggttctcctgccttccatagttggcttttgttctttagcagaggagtttgattcctatcagggcaggcattatggaaagggaagaacggttgtgtgaaatcgttcccccttgttctcgttctgcattcatccactttgcacctttttctgctaaatggtataaagagaattgtttgggaacatt

SEQ ID NO: 35473 - DNA, 122 bp, Homo sapiens
caatgtcattgctcctcaaggaactgtagagtaaaaccacaatgtgctgtcactctagacagtcaccaggatgattaaatttaaatcacaataacaaggctgatttcagatgtctcaccaca

SEQ ID NO: 35474 - DNA, 222 bp, Homo sapiens
caattttggcttttgttgccattgcttttggtgttttagacatgaagtctttacccatgcctatgtcctgaatggtattgcctaggttttcttctagggtttttatggttttaggtctaatatttaagtctttaattcatttgaattaatttctgtagaaggtgtaaggaagggatccactttcagctttctacatatggctagccagttttcccagcactg

SEQ ID NO: 35475 - DNA, 401 bp, Homo sapiens
  misc_feature 287: n=a, g, c or t
  misc_feature 288: w=a or t
  misc_feature 289: n=a, g, c or t
  misc_feature 290: n=a, g, c or t
  misc_feature 328: n=a, g, c or t
  misc_feature 329: v=a or c or g
aaccatcagccatattggcatacatttgtgaataacacacaatttcctgacattttggagcaagtaaagtgcgtaacataaatttttttggccatgcttaaagtagaatgagatccagctgggggaaagttatagatttcagccttggatgatcagtttaggattttgagaattgatgtttttccatatggtttctgttttcccccagctctccatttgaaccagctgcttgttttaaaactatctactaaattccatctacccactggttggtctgattttaaaanwnngagacctctttgaaacaaaatttgtttcctttattaanvtatgcaatgctgcaccgtctttaattttgaaaaacgccttggtaccttgcagcaggtcgttaagaatcatct

SEQ ID NO: 35476 - DNA, 170 bp, Homo sapiens
cagggaaggaagtaactgcaaaacactaggctttagtaggtacttatataaaatctagtccagttctctcatttaaaaaaatgaagaacactgaaatacagacttaaatagctcagatagctaattaggaaatttcaagttggccaataatagcattctctctgacacat

SEQ ID NO: 35477 - DNA, 202 bp, Homo sapiens
  misc_feature 83: n=a, g, c or t
acacacacacgggcctcctcgtcttcattcacaaaccccattagcttctgttgtctatgggcttcctcgacagaccgcgagcncctcgcggggggccagaaaccaattggaatgggacagaccctgatggggtcaggaacaaagagccagcgtgggagaggtgatcaatgagcaggaggttggccatcctcattcctccccc

SEQ ID NO: 35478 - DNA, 117 bp, Homo sapiens
cacggagtactccataatgggtacatttcattagctttattagaaaactagtaaatgcttttgaataggtagtatgacagctattttaaatgtataaacatttgtgtgccaaacaac

SEQ ID NO: 35479 - DNA, 363 bp, Homo sapiens
  misc_feature 192: h=a or c or t
  misc_feature 193: b=c or g or t
tcgaaaaaaactcggagctctcctggaggctgagcaggcaacagagcctgctcctcagctggatgtggcccgtgggaggtggagaaactgaggctcagataaatgactaagaagtaaagtgaggtcccatagccagtgaatggcagagcagggattcgaacccaggtctctcatctgggaagtgggatgathbcgccaacctagctggattgctgtgactgccagcacaatgccttctaagggttcaagagtctcgctctgtcacccaggctggagtgcaatggcacaatctcagctcactgcaacctctgcctcccgggttcaagtgattctcctgcctcagactcctgagtagctgggata

SEQ ID NO: 35480 - DNA, 299 bp, Homo sapiens
  misc_feature 12: m=a or c
  misc_feature 67: y=c or t
  misc_feature 105: w=a or t
ccctccacgggmggtccgttcctgatgccgtgggcaaatgtcgaagtgctggaattaaggtagtgcycaggcgcctccttggcttcatctcttagtgccttgggwcaccctactcagtgaatgttgccttttgaggtccagatggccagctgttctatctcacctggagtattaatttctcatctccaaagctttacttccacccagaaaagaccagatagtattaaaatatgatggtgtaaacacacgaggaattaaaaattttttggaaagcaattgtgtaaaaaagaaatgtaagc

SEQ ID NO: 35481 - DNA, 223 bp, Homo sapiens
acacatgcctgccttagggacctggtttttggcttcctgtttctggcttttatttgggtaacgtttataatggccacccgacttgtacctgggtaatgttttaactccttccccagagttctcaattagcatgaatttactacagtcagagtttcctttaaattggggtgggggtgctaagcactgaaaatatctttcttgattactttaccatgtggacata

SEQ ID NO: 35482 - DNA, 344 bp, Homo sapiens
  misc_feature 26: s=g or c
  misc_feature 115: h=a or c or t
  misc_feature 292: y=c or t
gattcttggaagtgacacctagaggsttgtatgaacactgggaattgaacttcagaatctccttgggtggaatgagttggattacatgcactcggaaggtcacttttattcctghgattctgtgaaggtctcgattggcaaatgagtgtgctactttacatgttcccatttaatcatcacaccaaccctctgaggcatgttagagaggtagagtaggttttctaaggtaatgtctaattaatggcagagcacactcccccacacatatagcttaattctcctacatttgtayggcccttccttcgttccttcgttccttcgttccttcgttccttccttccttc

SEQ ID NO: 35483 - DNA, 202 bp, Homo sapiens
  misc_feature 43: s=g or c
  misc_feature 161: y=c or t
  misc_feature 162: v=a or c or g
gctcaggaccgtggacgcgctgggtgtgctgaccggggcgcasttttctcgctgcagaaggaggagctgcgggcggtgagccccgaggagggggcacgtgtgtacagccaggtcaccgtgcagcgctcgctgctggaggacaaagagaaagtgtcagagcyvgaggcagtgatggagaagcaaaagaagaaggcggaatggc

SEQ ID NO: 35484 - DNA, 355 bp, Homo sapiens
  misc_feature 232: n=a, g, c or t
aacaagagctgcaggactcccaggccaataaacgtgttcacgtaaaactccagacagcttcttttagactggagtcttatcagggagacctcattttccctctaattaaaggaaagatttaagggagagaaaggaatagcctatgcctcttacttgtgcgggtcagtgttcgctgaattagaagttattccaacatgaacacaatcctcaggatgaatgactgcctagactntgaacgtaatggtcaaccagttttcacccgaattttgactgtttcatttagaagaaaagcaaaatgagaaaaagctttcctcatttctccttgagatggcaaagcactcagaaatgacatcaa

SEQ ID NO: 35485 - DNA, 303 bp, Homo sapiens
caaaaagaaatgttactttcctgcgattataattcttccttgactttgttcactttagatgttttactagtgagttttgatgactcccaccccttatgtgagaatgtgcatactttggaaacttgaatttatccaaacaagctacctatgacttagagtttgggcataagttttaaattcaatgctcagtcgaactggatctggttccaggcccactccaagggtggtttcaggggtgttttttcagtacttgtcccagaccacacaggtagccttgtttctgagggcagctttatgggaaag

SEQ ID NO: 35486 - DNA, 294 bp, Homo sapiens
  misc_feature 152: k=g or t
  misc_feature 153: w=a or t
  misc_feature 195: n=a, g, c or t
  misc_feature 277: w=a or t
tgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcakwtgctttcaaatctttttttaaaaaaatagtgtaaaatatttnaataagccaaagccatgtggaatttttgtttagatgccttaactgtgccacaccccacaaccccctatattattttggttgwctatttctcacagcgaa

SEQ ID NO: 35487 - DNA, 260 bp, Homo sapiens
caaaggagttatgtcttagagtccccagctacaagcctgattgccttctgggggagatctgactttgcataaaggctgaggccctcttcaggttaagtgaaggaacaaccctgcctgtggtctaacatttggcttatctctttgcccattcttggcagcaaggaggctgatagttgttatgaaagaggagtcagtgtggagagtaggaacttattactcttttttgcaaaatcttcctttaactgccccctagccatccc

SEQ ID NO: 35488 - DNA, 153 bp, Homo sapiens
acttatgaagtggttattaaagtgaacacagcacatatacattatctatactgctttttgttatgattaatactgggtatgttctggtaaatccatccttattgtatagaaaaaaaattacttttttaccaggttttccaaagacagaatgcc

SEQ ID NO: 35489 - DNA, 147 bp, Homo sapiens
tgtttagcgtaaaccgggaagcggatcgcgtggagtgaaagtcaccgcagcgatgaagttgcgctcttgttgcccaggctggagtgcagtggcgtgatctcagctcactgcaacctttgcctcccgggttcaagcgattctcctgcc

SEQ ID NO: 35490 - DNA, 134 bp, Homo sapiens
tttgtaacatagtggaggtactgtcaggcctctgagcccaaaccaagccatcacatcccctgtgacttgcacgtatacgcccagtggcctgaagtaactgaagaatcacaaaagaagtgaatatgccatgcccc

SEQ ID NO: 35491 - DNA, 137 bp, Homo sapiens
agtcgggcagcaggaaaccgaagacatgaacaaggtcttcccccagggagagaatggctacactgctgctgaatccaaagcccaccctggaggggaagcaggcggcggccacctctgctgctcacgtcgcggggctc

SEQ ID NO: 35492 - DNA, 307 bp, Homo sapiens
caatgtcattaaaacttaaaatggaatgagcgtaatttgaaaaacaaaatagccctggcacttctttttgtttagaacaacgtatagaaagcacatgcctcactgagaatacttagtggaatctcgataaccacaaaagcaattaaatgcttttaaattatagaaaacactaaaatttttaaagttgttcacccttggtagcttttaagtaaggatcacttgtgatttatagttgtagcttttcttgaacacgtcctcttgcactgatgactaacaaagttagttttaaacggaggtttgctggtgt

SEQ ID NO: 35493 - DNA, 178 bp, Homo sapiens
  misc_feature 120: m=a or c
ttttcttttgatttagagagagatgtcccagaagatgttgcacaagaaatggtagagtctgggtatgtctgtgaaggtgatcacaagaccatggctaaagctatcaaagacagagtatcmttaattaagaggaaacgagagcagcggcagttggtacgggaggagcaagaaaaaaaaa

SEQ ID NO: 35494 - DNA, 286 bp, Homo sapiens
  misc_feature 84: s=g or c
  misc_feature 85: y=c or t
  misc_feature 285: w=a or t
tacatgcatttcatttaactttgctatactgtatatattgtatatataacggacaaattagtcccgattttataatatctagtsyctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggagggwt

SEQ ID NO: 35495 - DNA, 246 bp, Homo sapiens
  misc_feature 8: y=c or t
  misc_feature 9: s=g or c
tccctggysgcagcctcctgaaggaaggaagattcagtctccactgagaggtgccgtctggcccttccctgcaggccagctgccccaagcggggtagcagccttgaacccacccagctgggacaccaccagaaggtccagggctctccccatgagataatcagagggaatgcaggacgtggtctatggtgagccaacgacacagtgagaaggagcaggaagttgctgtttctcctctgaccaaccc

SEQ ID NO: 35496 - DNA, 347 bp, Homo sapiens
ttacatgcaagagttgtttctgagcttcttccagccctcgttctctttctagtttatttagaatctgttgacaattagaacagttattttagatattgtggttttagcgttacaattctgttttttgcatacctgatgctatgagtggtaaaatctgtatgaaacagatgccaacattttcttccatcatttacatactcactttgcaagttgttttgctaagtccttatcacaggatcaacaataccttggcttaaaatagaagctcgcaagaaataccaactatttgcttacaaatatggggccaggcttcctaggccctgctttatgcattatgtcacagccaa

SEQ ID NO: 35497 - DNA, 400 bp, Homo sapiens
  misc_feature 312: r=a or g
  misc_feature 371: m=a or c
gggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaracagagaccctgaagatccgtatgctggatggaactgtgaagacgatcatggtggatgmctctaagactgtcactgacatgctcatga

SEQ ID NO: 35498 - DNA, 308 bp, Homo sapiens
acttccgctggtggcctagagcggggcccggtatggaggtgggctagaggccgacgccagccagagagcgaaatgttcttttggggccagagtctgggcatatatgaatgcaaatccgtgtttgttcacaactaagcccagctgagacgatcacttttctgtaggccatttgtccaggtatagaatgagcacatgttgttggtgtacgccaggtggtgcttccaccattgacttcctaaagcgctatgcttccaacactccgtccggtgaatttcaaacagccgacgaagacctctgctactgcttgg

SEQ ID NO: 35499 - DNA, 206 bp, Homo sapiens
agtgctttaacatcacattcccagttagtcattttgagaatgtattttctgctgtaatttcttttgcaaaccatagcacacttacattgttcatgtcttcttcagccaaaatactctccttcaaaaaagcaaacctctgctgtttgttaagtagggtatgctgttgagagaacagcatgaaatggtaacattttgcatcctccccc

SEQ ID NO: 35500 - DNA, 349 bp, Homo sapiens
  misc_feature 83: m=a or c
  misc_feature 98: r=a or g
  misc_feature 309: m=a or c
  misc_feature 311: r=a or g
taatttaagaatgaaactataaatcctgatgcctgggggtcaagtattttaagataagagggggaaaaacacataaagtcaamacaaaatgttttaaraattcataacagcaaccttgaaaaaatagacttaaatgaatgcttctagaaacttccagcggctcacaaagaataagactgccttagggctggcaacatctaagcctctaacagcacagggaagcaaatatcttaccaggcagcctatgaattaacccaaagaagctttggttggttttggtggatttttatcatgccatgttggacatgmgrttttttagatcttccttcccacattgctagacgtctca

SEQ ID NO: 35501 - DNA, 274 bp, Homo sapiens
  misc_feature 32: s=g or c
gttccacttgaccgctctaagccgccgcgcasctgcgttttctccggtacaggttgaggctactaaggtatttggctattataaataaaatagtgaatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagccc

SEQ ID NO: 35502 - DNA, 231 bp, Homo sapiens
catctctgtcctttcactggctgctgccccaggaagactcctctaggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatccct

SEQ ID NO: 35503 - DNA, 165 bp, Homo sapiens
acttctccctgctgccaccttgtgaagaaagtgccttgcttcccctttgcctaccaccatgatagtaaagtgtggtgattaagtcccttacatttaaagtcagattaccagggttcaaacttttgctcagcagtggcatggccacaggatcctctacacgaccca

SEQ ID NO: 35504 - DNA, 344 bp, Homo sapiens
  misc_feature 289: r=a or g
  misc_feature 296: w=a or t
  misc_feature 321: r=a or g
cgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaaatacatgaaatccagatatgaacaggttgaccttgttggraaaatgwctcaaaaggctgcaactactgtggracatttggccatccagtgtcatt

SEQ ID NO: 35505 - DNA, 207 bp, Homo sapiens
  misc_feature 93: m=a or c
  misc_feature 171: r=a or g
  misc_feature 189: w=a or t
  misc_feature 196: r=a or g
aagcgtgtagcgtctccacccgggctccaatccccagcctcgcactcagcaccaggcagagttcagcctcccgccgcaagctcccttccggcmgctcccggcgagcacgcagcccaaagcaccaaagggaaaaagtgcaggacgaaaaaaaaaaagtcatccatccatatrgtagaaaagcagctcaawttacgaragaggcccctc

SEQ ID NO: 35506 - DNA, 178 bp, Homo sapiens
cagaatggattcaaactttttaaaaagcttagtttctaaaaatcaagttgtacaagttgtggggctaaggcaggaggatcacctgaacctgggaggtcaaggctgtagtgagctgagatcacgccactgcactccagccagggtgacaaagtgagaccttgtctccaaaaaaaaaaaa

SEQ ID NO: 35507 - DNA, 328 bp, Homo sapiens
catttctattatttctaatatttgcttttgggttcattttgtttacattttctattttcttaaagtggaagcttagattagtgatttgagatttctcatataaacattttatatcataaattcccctgtaagcactgttttagcagtatccctcaaattttgataggttgtatttttattaattcaaaatattttctgatttcccttgatattccactttgacttatggattatatagaagtgtgttgtttaatttccatgtgtttggagaatttgctattatcctttcattattgatttctaattttgttacagtttaggaggacac

SEQ ID NO: 35508 - DNA, 67 bp, Homo sapiens
aaaaaaataaatctaagaaagaggaaaaacaggaatgacctcctttcaggcactctgttggttttat

SEQ ID NO: 35509 - DNA, 457 bp, Homo sapiens
tgcatattgaaaagcacagaggatttctttagtgtcattgccgattttggctataacagtgtctttctagccataataaaataaaacaaaatcttgactgcttgctcatttgattttagatgtattttctctggcttacttttgtttgcttatacttgtttatttctaaaagctaaaacaagccctgaccggaagtttcaccaggcagaaacctataggctccaccacttttgctgcctctcaggtgccacctttcaacccacttctcccaactacttatcccagctcctgaccccgaggccctggcatctactgtgaatattttttttttgaatttttatacttcgctgctcccaaatgagcaccccgagagaagtccaggcttcatgtacttgcccaggaattccttgtccccggacccggaatcacttggcctaattccggtcagtctgccttt

SEQ ID NO: 35510 - DNA, 254 bp, Homo sapiens
cagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaactg

SEQ ID NO: 35511 - DNA, 346 bp, Homo sapiens
ccctcaaatgtctgacacagaatccatgcccttctcatgcttcttctttgccaaaatgctaattagacccatcagaaccatgcagcaactgttcgaatatagatctgttgcgtttacatgtatttgttcattgtttattgcttctctcctctcatggtgcttacacctcctgagagcaggggccatgtctgttgtattctgctttgtttcccaagacctagagtagtctgagtgtctaaatgtgtgtttggttgaacgcgtgcctgagtgtacaggtgcactaatagaaactgaactgattggctctattaagtctcagactgttcagcatgattgttagaacctc

SEQ ID NO: 35512 - DNA, 419 bp, Homo sapiens
  misc_feature 137: s=g or c
  misc_feature 138: m=a or c
  misc_feature 323: k=g or t
  misc_feature 324: w=a or t
  misc_feature 373: r=a or g
  misc_feature 384: b=c or g or t
tatatgtgtttcagcatgttttggtgaatcttcattccctttcctgccccttgttttccctcctcaaaggggagaaattagcacaaattagtatcaggattgtgcaggaaataaacatttgtgaaggttaagcaaasmggaaaaggaagttatttcttcaacagattaaggatttttctacacacagttcttttgtggcattggccacatgtccattagaccaatttgatagtatcttcggtctgcattcaaagccagctcatgcaatgagtattcagcctattcttccaagacaatctggacatagaccagagggagatttkwctccctctgtgccctagatagctcattgctggcttactcttagagttgraatgagagggbtttgtctgcattttgagtagataccatctatctta

SEQ ID NO: 35513 - DNA, 259 bp, Homo sapiens
aaaatgtgttcttagaaatgggcctatagtttagtaacctatagtttggtaataggcttgtttgttttcagatggattttggttctgtgagctaaagctattttgcattaaagccttcgtcctcacacattgttttgacatatttctagtcttcataaacttttttaatttagatttttttcccttcacaagtatacatctgttttagcaaatagccttatgaaggttgtagatgtattattttgggcatgcctggtgc

SEQ ID NO: 35514 - DNA, 234 bp, Homo sapiens
taatcagtaagaagggagaaaaacggaataaaggagagaactgtccaaataagtgtctgacactgaggaaggttgtttgaggatggtgattgctgaaaagtttccataaaatgattctctagagggaactatgccaataccatatctgttaacatcttagacccacagggtcatattggaacctttgctagagtctgagatggtaaaacattaactcgaatagtaaacgtcgaa

SEQ ID NO: 35515 - DNA, 464 bp, Homo sapiens
  misc_feature 286: m=a or c
  misc_feature 287: h=a or c or t
  misc_feature 317: m=a or c
  misc_feature 331: r=a or g
  misc_feature 336: m=a or c
  misc_feature 337: n=a, g, c or t
  misc_feature 339: v=a or c or g
  misc_feature 345: v=a or c or g
  misc_feature 354: v=a or c or g
  misc_feature 398: k=g or t
  misc_feature 399: n=a, g, c or t
  misc_feature 425: h=a or c or t
  misc_feature 427: m=a or c
  misc_feature 431: n=a, g, c or t
cattctcagtaaactatcacaagaacaaaaaaccaaacaccacatattctcactcataggtgggaattgaacaaggagaacacatggacacaggaaggggaacatcacactctggggactgttgtggggtgggggcagaggggagggatagcattggaagatatacctaatgctagatgacgagttagtgggtgcagcgcacagcatggcatatgtatacatatgtaactaacctgcacattgtgcacatgtaccctaaaacttaaagtataataataataataamhataaataagatacagctaaaactgaaaaamaataaaaataaaaraatamnavattaavaaataaaavaagttaaatgaaataagccagtcacaaaaagataaatactgtcknttccacttacatgagcaatttagaghgmcagnaagtagaatggcgcttctagggttttggggcag

SEQ ID NO: 35516 - DNA, 134 bp, Homo sapiens
taatactgacttgaagatttttgtgatattatatctaagtacttcttagattcaacattttatttactttgctcctaaaattattttgtgcaatgatttctggcattcttgcaaagtagtaaatatacagagat

SEQ ID NO: 35517 - DNA, 105 bp, Homo sapiens
acttcctgctgccacgtggcagaagggtgtgtttgtttccccatctgccatgattataagttttctgaggcatccccagccatgctgaactggaagtggcactaa

SEQ ID NO: 35518 - DNA, 156 bp, Homo sapiens
cattgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgc

SEQ ID NO: 35519 - DNA, 158 bp, Homo sapiens
  misc_feature 72: n=a, g, c or t
  misc_feature 73: n=a, g, c or t
aaaaagcttgagtttcctgccagtcgggagggatgaatgcagataaagggagtgcagaaggcacgaggaaannaaagtgctctgtatcctccagtctccgcgcctccacccagctcaggaacccgcgaaccctctcttgaccactatgagcctccctc

SEQ ID NO: 35520 - DNA, 322 bp, Homo sapiens
  misc_feature 280: w=a or t
  misc_feature 281: m=a or c
ctttcatgataaaaacactcaacaaactaggaatagaactaaactaccttaacccaataaatgccatttatgaagagacaataactaataactaatatcacacttgatagtgaaaacctgaaagctttccctctaagatcaggaacaaggcaagattgcctactcttgccacttctattcaacatggtactggaactcctagccagagtaactaggaatgaaaaagaaataaaaggcatccacattggaaaggaagaagtaacattatctctgtttgctwmtgtatgttttatctagaaaaccctaaatattccacaccacc

SEQ ID NO: 35521 - DNA, 264 bp, Homo sapiens
tactaaaactttggtggaagctaacaatgaacatatggtagaagtgaggacacagttgttgcagccagcagatgaaaactgggatcctactggaacaaagaaaatctggcattgtgaaagtaatagatctcatactacaattgctaaatatgcacagtaccaggcctcctcattccaggaatcattgagagtaagtatttgtatcctaaagattattttaggattttaaagatgattttactttggagttttgaaaggacacac

SEQ ID NO: 35522 - DNA, 419 bp, Homo sapiens
  misc_feature 10: s=g or c
atgcgcgtastccctgggcgcttcgaagatccagcggcttgctgtgagtccgggaggcaaaattgtacccatttcaaagatgtgatgactaaagtctcgagagggccaaggctcgcccaaggttgctctgtggtgacagctttacctccttgctatgtattctcagatattgcaaacggacgagagaaaagtggagaatgaatcctggagaaaacaaggtcgttcgacgatttcgacacgtcgcatccctgagagtctctcgtgtcctgatcaactcgagaactggaggcggtgacattttagatgctgcagtgaaagccacagagccacggaaggccgagactccaccatgtttgtgatcttcacattcagcaaactcactcgcactctgcctcatcttatctctagaatgtatttta

SEQ ID NO: 35523 - DNA, 178 bp, Homo sapiens
  misc_feature 95: k=g or t
catcaaaatggtcttgccctccctgtagtggaagaaggggaggttctctcacactctctagaagcagagcacaggttattgaaagctatgggttkgcaggaatatcctgaaaatgatgagaattgccttcccctcacagaggatgagctcaaagagttccacatgaagacagagctaa

SEQ ID NO: 35524 - DNA, 305 bp, Homo sapiens
aacagaactgacttggtttccggccatccggttccgctccctgggggagggtttgtgtcatagcaagcgcccaacatttcccagggcagtgggtgctccgttttggagccgctgcccagacctcttggctgtcatcgcctcatggcccagggtcagaccccctgggtcttggatgggttgactctcatcacaggagcacccagtttaatcttgtagtgggcaagggagcaggcagtgggtttttggaggctaggtttccagtgtcttttcccccttttaattcaataaacatttatctagagcac

SEQ ID NO: 35525 - DNA, 245 bp, Homo sapiens
  misc_feature 211: w=a or t
  misc_feature 221: r=a or g
  misc_feature 224: w=a or t
  misc_feature 233: w=a or t
  misc_feature 240: y=c or t
acagaaaaagaagggaaattagcaatactagagaagactttcctggagtttgaggaaccttaagaaataagtcaatgtttagaattttctttgtggtagataggccctgtcgggggaactcaaaggtgaaaggtcagggaatgctccaggaaacaggtgatgtagggaggtgtctgtgttgctataaaaaaaaaaatatctgagactgggwaatttataargawtagatattwatttttycatgc

SEQ ID NO: 35526 - DNA, 206 bp, Homo sapiens
  misc_feature 94: y=c or t
  misc_feature 96: y=c or t
  misc_feature 98: w=a or t
gaaaagactgcatggtctctgaagcagcatgatcagcatgactggctgcatctgggctccaccgtttgccacttcagacaggtccttaagcctycytwagaggttcattttccttgctgtagcccggagtaagaatgtttagcctacaagatttattttgaggcatcaatgaatcactatgtgagcctcacacagtgtctggcgaa

SEQ ID NO: 35527 - DNA, 78 bp, Homo sapiens
  misc_feature 2: s=g or c
  misc_feature 63: r=a or g
astttgcaaaagccagaggtgcaagaagcagcgactgcagcagcagcagcagcagcggcggtrgcagcagcagcagca

SEQ ID NO: 35528 - DNA, 247 bp, Homo sapiens
  misc_feature 89: m=a or c
  misc_feature 90: w=a or t
  misc_feature 93: r=a or g
  misc_feature 96: k=g or t
  misc_feature 113: k=g or t
caactattatagtggcttagagacactagttcgtgttcttcgtttctatattagtaaagatgttagaggaaattaatctgtttgttgcmwcarggktttaatgtgaccatgtkgtataactattctgaaaggtaagaagtttttcactggagtacagtcactggctgagaacatttaagttttcttttgaagcatacacagttaacaactattgcaggaagaactctgaattaaatttcagggccca

SEQ ID NO: 35529 - DNA, 294 bp, Homo sapiens
  misc_feature 117: r=a or g
aggaatttaatattcttgtaatggactagataattcaaactgattagcccattccagaagaaaaacagctgggaattaagttaatccactttgaaaattgttttacaataatcagarcatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccgcc

SEQ ID NO: 35530 - DNA, 265 bp, Homo sapiens
ctcaaactcctggcctcaagcagtcctcctgcctctgccttctaaagtgctgggataacaggtgtgagccactgcaccgggcctaaagtctaaattcctatgtggccctgcatcactgactcctgcctgcctctctgacctcatcttacctcactctcccttttcctccctaagctgcttccatcaccacactggcttctctgtttcctcccaggtgcctctctccttcctctggcagcccttgtacttgctatatacccagccg

SEQ ID NO: 35531 - DNA, 412 bp, Homo sapiens
  misc_feature 272: w=a or t
  misc_feature 300: w=a or t
cataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcawgcctgaaatcccagctacttgggaggcwgaggcaggagaattgcttgaacccgggaggcggaggttgcagtaagccgagaccatgcttattgccctccagtctgggcaacaaaaatgaaactccgtcaaaaaaaaaaaaa

SEQ ID NO: 35532 - DNA, 201 bp, Homo sapiens
ttaccatgttggccaggctggtcttgaacgcctgaccgcaagagatcctcctgcctcagtttcccaaagtgctgggattataggtgtgagccactgagcctggtcaagcccaggaatttgaggttacagtcggctatgattgcaccactgcattccagcccaggtgacagagagagacactgcccctaaaaaaaaaaaaaa

SEQ ID NO: 35533 - DNA, 264 bp, Homo sapiens
  misc_feature 222: b=c or g or t
catcagaacttgaaacctcctctccttcatgtattagtgatcatgtttctccataatactgctagaaacaagaattgaaacctggaaaacctgcatttgagaaccagatctccctctgctagctatttgagaagttattttgttccattctttttgttgttgtcgaaacagggtctcactctgtcgcccaggctggagtgcagtggttcaatcttggctcabtgcagcctcaatctcctgggctcaatcaatccttccacatca

SEQ ID NO: 35534 - DNA, 324 bp, Homo sapiens
  misc_feature 71: w=a or t
  misc_feature 72: m=a or c
  misc_feature 281: r=a or g
caatggattcgtaatttctttacaaaatttcttatatataatatgtgtatctctgtaataatagagccctwmttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcarcaaaactgtattcttatgaaaagaactatttgttacaatgaga

SEQ ID NO: 35535 - DNA, 137 bp, Homo sapiens
  misc_feature 113: s=g or c
gtccacactgcctttatgagctgtaacactcactgggaatgtctgcagcttcactcctgaagccagcgagactacgaacccaccaggaggaacaaacaactccagacgcgcascttaagagctgtaacactcaccgc

SEQ ID NO: 35536 - DNA, 238 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccgaca

SEQ ID NO: 35537 - DNA, 174 bp, Homo sapiens
actagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagca

SEQ ID NO: 35538 - DNA, 395 bp, Homo sapiens
  misc_feature 372: r=a or g
  misc_feature 373: m=a or c
gatgatctctgtacgctggtattttgcgcctggagccaggtgtctgttgacagtggggaggaggtggggaagacccagccggccgagagcctcagccaccttcctgcaggaggtcctcacaccccagacggtcagaatgctccccagactgaggaatcagctgcacatccccctgatgtctctaaagctgaaatctgcttcctgggtttagccaccattttcattgagcagttctgaggattccttgtgggtacttgtgatcttggtggagatgcttcatggtgttgaccctattgttttgaatacctgacagctggatggtccagggcctatttctatgatctgttttttggaactgttgtatttgtgtgrmacagtgatgggagcatgatgtc

SEQ ID NO: 35539 - DNA, 406 bp, Homo sapiens
  misc_feature 365: k=g or t
tgcttatttaatcctcatgccaacctgatggagttggtggtatttttatccttgttttacaagcaacaagattgaggcctccccaaaattaataacttgtcaaataacacacagaagtggtacacgggaatgtgaacacacagtctggcaacagagtccctgctcttccctcctgctccaggccatctgtcactgggccaccccctctcctcagccacccctcccctggttgctggaggaaattgtgtgcttctgagtcaacttctataacagtggaaacacacatgcttcattgtaaagatcaagtgtggttgtctgcctgtgtcatgttggtataatatcttggccactgctggttttttgtkttttataaatatggttggtggggggagcagaaaagaaagtc

SEQ ID NO: 35540 - DNA, 273 bp, Homo sapiens
ctttggagaacagatgaacattattcaccatgaatggatctatactgtgtggtcatgagttgtgtatacttccataacactgtatttttccttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatt

SEQ ID NO: 35541 - DNA, 347 bp, Homo sapiens
  misc_feature 230: s=g or c
  misc_feature 313: w=a or t
aatattggtgacgtgtcaagtctttctcatctttctctgcttctctccattatacattatttatcttgctggtctattaagatttgattcaggaaatacctttttaaagtcagtaattatacatagatgcacacctatatcaacaagataaacccagttatttcccctcagggttttccttgaatagaaattatgttccatttgaaatactctttctaatcaacagatgsactgattttatagaggtttaactttgccatatagtattcagattcagtcctgtaaatcatatgttgtatatatattgcttggwtttgctttcctaagttcttttacattcatttatt

SEQ ID NO: 35542 - DNA, 145 bp, Homo sapiens
  misc_feature 85: s=g or c
ggagagaccctaggacagcctgagagtaactggacctggtattggtgcggagtggggaatatcccttgtctaaatgcagagcagsctgagagaagttagcggggctcttcctccgttctcattgtttcctgctttccttcccctc

SEQ ID NO: 35543 - DNA, 340 bp, Homo sapiens
  misc_feature 331: w=a or t
cgaaacagataagacaaaagatacaactatctttgtaaaaactttttaaaaacaagtgactggttatgacaaaatatttgtaacatttcatacaaaggatttgtaatctacaaatcatttaaaaaatgataagcaatagaaaggtgggcaaaggctttgaaaaagcaattcatgaaagaggaaatacctcaaacttacgaaaagataatcagcatcatcagtaatcaggtcagtgcaaatgaccaacaacaacgagaaaccgtttcccactgtctgactggcagaagttaagtttggtcccatcagggacgtggcaagcactttggcagcwtctgtgaaa

SEQ ID NO: 35544 - DNA, 376 bp, Homo sapiens
  misc_feature 91: r=a or g
  misc_feature 218: h=a or c or t
ttgtgagacagagtcttgttttgttgcctaggctgcagtgcagtggcacaatctcggctcactgcaacctccgcctcccaggatcaagttrattctactgcttcagcctcccaaagtgctggaattacaggcgtgagccactacacccggcctaaaaattttttattttgttttgtgagacagtcttgttttgttgcctaggctgcagtgcagtggchaatctcggctcactgcaacctccgcctcccaggatcaagtgattctactgcttcagcctcccaagtagctgggatgaaggtgtgtgccaccatgcccagctaatttttgtatttttttagtagagatgaggtttcaccatgttggccatactgggctt

SEQ ID NO: 35545 - DNA, 263 bp, Homo sapiens
  misc_feature 92: m=a or c
agtcccttctgagacagaaggttgtgttggggaactgaaggagattctgtgggcggacagggaaccctgcgtttctactgtgtgattctgcmaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcaaa

SEQ ID NO: 35546 - DNA, 389 bp, Homo sapiens
caatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctat

SEQ ID NO: 35547 - DNA, 212 bp, Homo sapiens
tgagagaaattaaattggtttgactctaaacaggtgccaaggaatgaagaagatgcagttttcataggaagatgtgcatcattagtttatgaacaggcattcatttgtattgcactaagaattttagattttctttaattagcttgaggtttatctttacctggcgtgttttttcttcaaagtaaaaattgtttactcttattaccagtaca

SEQ ID NO: 35548 - DNA, 335 bp, Homo sapiens
  misc_feature 265: s=g or c
tttgccactttaagagtcttaatcttgttattgtgattaggtagttttttcttcttttacaccaatagcacagacatagctttgagtgtaaatttcttaaaagtttttctgattagttgatatggctagtacttagaagatgcttacatcaaaaaatagcgttctttttcaaagcgatttctaatatacaatattaattataacacaaaaatattttttaacgtttctttttattttagattcagggggtacatgtgcaggtttsttacgagagtatactgcatgatgctgaggtttgggcttctattgatcccatcacccagatagtgaacaca

SEQ ID NO: 35549 - DNA, 333 bp, Homo sapiens
  misc_feature 121: k=g or t
tatatggagtatcatttcatcctcataggaaccctgcaagggagatctccttgttcccacttagcacaaaataaaactgacgctcagggagatttttaaaaagctggaactaggacaattkcaaacaacaatctagaaataaggtactacctgttcaaacagcctgctgaatatttggggagaaaataactccttttcaccgtggacactgtcaacacacgttacttcatcttttaaaaatgtatctaaaatgtgttgaattgcttaataaatactcacactttcaatgtaaacgctcttcttttctatgtgctccatatcgctttgccctct

SEQ ID NO: 35550 - DNA, 371 bp, Homo sapiens
cagctctgtaaacagtcctttctctaaggagcccccagtaactatcttccaagtgtttacttggattcatcttacgccagacatgatgcctagcctgtggcattcataagcagctgcaaaaagaaggtcaaatgccctgcccaaggtcatgcaggtgatagtccatcaggctcaggattagggtgtgttgctggcaaagccttttccctgaagcataccatcttcatctgtgtgagcgctctgtgtcaacagacacttgcagtattgcacatgtgcaagagacaaggtcagccgtgtgtgctgggcacgatgagttcaggattgtgctttctgcatctaccgttattaccagacagttggcatccagccca

SEQ ID NO: 35551 - DNA, 232 bp, Homo sapiens
  misc_feature 170: w=a or t
caatattaatgaaaatctgtttagtatttttctaaaaaaattaactcatgttttgtgtatttatttatttattcatttatttatttttgaggcggagtctcactctgtcgcccaggctggagtgcagtggcaggatcttggctcactgcaagctccgcctcccaggttcwtgccattctcctgcctcagcctcccgagtagctgagactacaggtgcccgccaccacgccca

SEQ ID NO: 35552 - DNA, 312 bp, Homo sapiens
  misc_feature 151: m=a or c
  misc_feature 195: n=a, g, c or t
  misc_feature 196: v=a or c or g
  misc_feature 270: r=a or g
caatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaamaatacaaaaaaattagcccggtgtggtggcaagtgcctgtagtnvcagctacttgggaggctgaggcaggagaactgcttgaacccgggaggtagaggttgcagtgagccacgatcatrccactgcactccagcctgggcaacagagcaagactccatctc

SEQ ID NO: 35553 - DNA, 211 bp, Homo sapiens
cttttatgcaaggaccctgagtcaaagccctactttctattactcctcgggaactgtgctaggtgttctaatgacattagtctttgtcttgctgttggtgaaaagattcattccgaagtatagcaccttttgggctctaatggttggttgttggtttgcctcagtttatattgtatgccagttgatggaagatctgaagtggctgtggtgc

SEQ ID NO: 35554 - DNA, 88 bp, Homo sapiens
  misc_feature 2: k=g or t
  misc_feature 22: k=g or t
  misc_feature 30: k=g or t
  misc_feature 60: k=g or t
tkaatgtcgcccttggattatkaaagactkcgaaagatgacctgctgttgacagactttkaaggtgccttgaagttctttagggttca

SEQ ID NO: 35555 - DNA, 244 bp, Homo sapiens
  misc_feature 139: n=a, g, c or t
  misc_feature 140: y=c or t
atccacatttaaaactctgtgttaaccaaacaacattatagaccaaatcagaacaccgggccacaatttacaactgatggtctggagattcaagtaggcaagagtggagggaagtaacaaaggtaataccacctaaaanyaagatgaaagaggtgcgatggaaatctacctagagtgccgaaagagcagccacccgaaaggctggagaagtgggcccgataacaaactcccgaacgagggggtg

SEQ ID NO: 35556 - DNA, 242 bp, Homo sapiens
  misc_feature 99: k=g or t
agggtgtagattgggttcctcagagattgctaaagctgatatcataaattacctaaggacagggagaatgaagtgaattgtgtaaatgtctacaatatkatacttttcttgcttatactaagctaaactagtatggatgacatgtagtaaaagttataaaaggaaattcatcttcacctgtgtacatgcaaaactgctgcatttgcagattaagtcaaaattatatatagagagagacacac

SEQ ID NO: 35557 - DNA, 248 bp, Homo sapiens
cataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccaga

SEQ ID NO: 35558 - DNA, 398 bp, Homo sapiens
  misc_feature 297: m=a or c
aaagacaaacaacccagtaggaaaatgggcaagagacttgaatgggcacttaataaaaaatgatattcacatggccaataaacatatgagataatatcaaccttatcatgaagtcttgttgtgattttaatttgctattccctgattgttaatgaggctgagttctgtttcacagaaaccttgcaaggttaaatttaacttatactaaggaatggtgagcatatggagcaaacagaaactttgtgacctgctggtgggtgtgtaaattggtataatcattttggatgatagcttggmgttatttactgaaattgatacatgccctgcaacctagaattttactcccagttgtatacctaaaactgatgtgagcacaggtgctctaagcaatatgtata

SEQ ID NO: 35559 - DNA, 140 bp, Homo sapiens
attggaaaaaagggctcaagaagctgacttcagaggtaggcaaatgggcaaggaacagaagagagtaataccttcctcaagttaatatgtatttctaatgaattatttctgttttaattagttaaaaaaactggtgccat

SEQ ID NO: 35560 - DNA, 126 bp, Homo sapiens
  misc_feature 90: k=g or t
tggagaatttgaaagacttttatgtgttgtttgtattctctagcattccccttacatttctatttcagaaattgccttttgtttggattkgagaagagactttggagacatggtatttgaagagct

SEQ ID NO: 35561 - DNA, 299 bp, Homo sapiens
  misc_feature 163: y=c or t
  misc_feature 183: y=c or t
  misc_feature 259: s=g or c
ggctgatctgttatttctcagttacagttagcaaactttaaaaacttaacactcaagttggctttgattaaaaggtaaagatgtgttttaaagtggataaggaaagtctgaggccttatttggaacatcactaagtcttccacaggttttttgtttgtttgtytttttttgttgttttttttycttaagacggagtcttgctctgttgcccaggctggactgcagtggtgtgatcactgcaacctctgcagctcactgsaacctctgcttcctgggttcaagcaattatctgcctcagc

SEQ ID NO: 35562 - DNA, 197 bp, Homo sapiens
  misc_feature 89: y=c or t
  misc_feature 91: s=g or c
tgaaccccgatggtgtggtccggggacactaccgcacagactcacgtggagtgaatctgaaccgtcagtacctgaagcctgatgccggycstgcacccggccatctatggggccaaagctgtgcttctctaccaccatgtgcactctcgtctgaactcccagagttcctctgagcaccagcccagttcctgtctccc

SEQ ID NO: 35563 - DNA, 202 bp, Homo sapiens
  misc_feature 60: y=c or t
taaataaataaataaataaataaataaaaacaaagttgattaagaaaggaagtataggcyaggcacagtggctcacacctgtaatcctttgcattttggaaggctgaggcaggaggatcactttaggcctggtgtgttcaagaccagcctggtcaacatagtgagacactgtctctaccaaaaaaaggaaggaagggacgcc

SEQ ID NO: 35564 - DNA, 363 bp, Homo sapiens
  misc_feature 92: k=g or t
ccctttaatcaactcacacctgtttaaagagtgtttctgatttgaccttcatcccttagtttactggcgttaaaaaaagtctcagcaatttkcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggcagaggggaggtgacatgtttagagtca

SEQ ID NO: 35565 - DNA, 123 bp, Homo sapiens
aggaagtctcgtatcgcgcccgggaggcgccggagcccagcggctggcggctgtagtgcagtggcgcgatctcggcttactgcaccctccgcctcccggattcaagcaattctgcctcagccc

SEQ ID NO: 35566 - DNA, 189 bp, Homo sapiens
cctagtgggtgatgacaatgtattagtggctgtgggctgggaggcggtcgttgtcatagaagtcactgtatttgtggaagtgattgaagaagtgatggaggaagtggaagtcactgctgttttgagagtagtaaatactggggttggggacgtggttgtatggatgcttccagtgggcaggggagtcct

SEQ ID NO: 35567 - DNA, 184 bp, Homo sapiens
  misc_feature 127: m=a or c
taaatttccaatttattctagatttcctcagagcataattattctgttaaatcctcaatgagtgtgatgtaaaccacctctatccacaaatatacattcttttctcatcatgttggacacagttgtmggtgacatgcacagaactggaacagatcactattagtggaaaataccaaatggaccc

SEQ ID NO: 35568 - DNA, 176 bp, Homo sapiens
agatttgtgacttccatttatccttctggtgaggatgatgtcataacctcaccttataatagcatcttggcaatgaaggaacttaatgaggcatgcagactgtgtattgcccattgacaatcaagtaagaaatgacattggaacttatgaataaatgttatatatattcagtccat

SEQ ID NO: 35569 - DNA, 120 bp, Homo sapiens
  misc_feature 89: r=a or g
tctggtttctggccccttgtctgcagagatggctcccaatgcttcctgcctctgtgtgcatgtccgttccgaggaatgggatttaatgractttttgatgccaacccatatgacagcgac

SEQ ID NO: 35570 - DNA, 286 bp, Homo sapiens
caccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaactgc

SEQ ID NO: 35571 - DNA, 213 bp, Homo sapiens
accacattcttttctttattgtaaactttcttatgacttttttatatatctgccatgttctaaaaggcatttaagccttcttacactgttttgtctgcttttcattaagtttgccatcaatttacaatccatgcccattgcctccttcacaatctgaatacataaacatgcataataaataaactctggggttgaatcctggactgagtggcc

SEQ ID NO: 35572 - DNA, 300 bp, Homo sapiens
  misc_feature 88: r=a or g
  misc_feature 180: r=a or g
  misc_feature 255: r=a or g
  misc_feature 260: r=a or g
  misc_feature 266: r=a or g
  misc_feature 279: r=a or g
ccgaatgcaatagaccagccatctgatcaaagttgaattgttttctctttccctcccaattttccaatttttagtagctaataagagrgttaacattgacttaacagctttaaaaaaaaaaacagccatgctattgtgaagcagagttattattttttttatactccaggtagtgttctrgatgagaaagaggtaagaatgaggggaatgggcacaattttggaaatcaatcccaaagagcctgagtaaatgaarggccrctacgraatgacgccaggrgtaacaacggaacttcacttt

SEQ ID NO: 35573 - DNA, 362 bp, Homo sapiens
  misc_feature 330: r=a or g
  misc_feature 331: n=a, g, c or t
caaaaacgccaagttcttaccaggaattaccagctgactcagtcatagggttctggacagcttaggatcctccaaccctcgatttcttgatttcagcaggaagatagttcttttgttacccttctctaaaagaatggaaaatgtaacactgcgtttccatggaggcctctaaagaaagatcattctcctttagaagagcatccaagaaattatactcaaaacaaatcttcttttggcaggacaccatttaatcagctgaaagatatttatacctgtgcttgtaattctatggcttgtcgtgggaagggagaagaggaagttaggaatcarntgctccctcatttttcagaggaatgattgga

SEQ ID NO: 35574 - DNA, 371 bp, Homo sapiens
  misc_feature 96: y=c or t
attattttgaatcaggttttctggtactgagtactgggagtaggtgaaaaaccttgaatgcttcaggttgctcgagttagtaatcgttgactttcytggtatgacattaagaaagtggatgtggacagattgacaagcaaatatctcatttatttttttccttttctatctaatcgaatttgattttcccctacttgttttagtacttttgtacttacatattgagacttaagctattgttgggagtaggtagcaaatgattacatgtaatttcttttgtctgaaaattaagaggaaaagagcttggttcttgtagggggaggtgtatttgcaattatttctatggcagaatttattagaattggccgtcc

SEQ ID NO: 35575 - DNA, 401 bp, Homo sapiens
  misc_feature 280: r=a or g
cagtgtgtttctttattactgtagtgcagacagcagtgcttgtatgatgaaggcaattttgttcagtcagcctttacaaataacggatacacaggcaaggttgcatagctccagtagagctcaggtatgtattttagccagccagctagctagcaacccattgccaccacctactgtctcccatcctgactatcactgtaatttaaggaaagaaaacttcagttctgcctctggataccaagatgcccattgctcagttcagacaactgatattaaaatraagctatgctccttacttacttcttttattataaacaaattcctttgctttggctgatactagctgagtcattgatcatcattggtaccatgatattgtaatctatgctgctatttggcac

SEQ ID NO: 35576 - DNA, 284 bp, Homo sapiens
tgctcggtagccagcatgcagaagcataactggcagaagtggccttcccatagggagtgcttgacttttaatggattattgtcacaaggtgtataggttgatttcctcaaaggtgagtgatggtttctttctcaggaagacaggtgatgatactaaattgaggggagagccatttgacaagcatatgggaggcccatattagtcttcacaatgtgcaaattcaaatgaataaaaatgtataagattaggaattagaacagagattaaaacatactgtacacccc

SEQ ID NO: 35577 - DNA, 448 bp, Homo sapiens
  misc_feature 321: h=a or c or t
  misc_feature 322: v=a or c or g
agtaggatccagtctgtggggcaagccaggcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagchvggatgggaccagcgactgagagagccagaggcagagaggtgagggtgacatatcctgactgtgagaggaatggactctgggctgtagctgcaagcaggtggcaggtgctccaggctgtgatctgca

SEQ ID NO: 35578 - DNA, 209 bp, Homo sapiens
ataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcacc

SEQ ID NO: 35579 - DNA, 319 bp, Homo sapiens
caagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagaga

SEQ ID NO: 35580 - DNA, 57 bp, Homo sapiens
catgacattcctaattaaaaacaattttttaggctaaaacttttcagtttttttttt

SEQ ID NO: 35581 - DNA, 187 bp, Homo sapiens
acgggcagagcacagtggctcatgcctataatcccagcacatcgggggaggccaaggcaggaggatcacctgaggccgggagttcaagactagcctaggcaaaatagccagactccatctctacaaaaaagtaaaattatctgagtgtgatggcatacacctgtagtcccagctattcgggagggca

SEQ ID NO: 35582 - DNA, 223 bp, Homo sapiens
  misc_feature 136: n=a, g, c or t
ggtagcttatacttgcgtattaaacatggtgtggtggttctgggtaatattctccaacaatcaaaacaaagtctcacaaaatcccaaacccatatacctgtgttccatataccttatgctttggtcatcctgatgntttctaaataagctttatatatttatgtgatttatggatttgcctttttttgtcccttatgatattcttcctccttctcccatcagc

SEQ ID NO: 35583 - DNA, 291 bp, Homo sapiens
  misc_feature 268: b=c or g or t
tgtgataaaagctttggcctgaggttccaaccattaagtttgccagctcagacttgatcttgaataaggcggggttctgtgactggagaccatttctccttttgtatttgttggtgtgtccaaaaacctcagatctcccagcttcaggcttctttgagggcagtgctaaattggttgaaaccttatttgaggcagttcctgaaaagggtaggtgaaatttcctgctgataaaaggcatcttgtgtcttgttcatccttagcaaattgbcaattagcaaagaagagagggca

SEQ ID NO: 35584 - DNA, 161 bp, Homo sapiens
acagtttttgagaatctgatcaataaaatgtggcttggggtcccatctcaggataagatggaaatccgtactgtctgcccaaactccttttggctcaccaaaaccttaccttactttatccggaacaagctctgcaaagttattgttgatattggacgttg

SEQ ID NO: 35585 - DNA, 261 bp, Homo sapiens
atagtcttcggggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggtacgccgtcagaatcggtttttcagtgagttttgacccct

SEQ ID NO: 35586 - DNA, 157 bp, Homo sapiens
catcatgcttgtaacaggcatttcatttataataagaatgagttattcatttgtaagccgttcagtaatttatctactattcctaaattggcataatgttagataatctattttgaatcacctttaattacatgtcagaatgccttaactaccctat

SEQ ID NO: 35587 - DNA, 195 bp, Homo sapiens
tgtcaaggcttttatttatgtatgtcactcatatccttgttttctgttttaaattttaggttcttggggtttttctctgtctgtgagtacttggtaaaaagttaaaccctaaagataaaaggcagcaaatagtgaccaaacgaatgtttttggcaaatacattggtgaaggcctccttcaggtaggtagagagga

SEQ ID NO: 35588 - DNA, 355 bp, Homo sapiens
cccattaacagaaaggagaaacattgacaatagttgttgcctaatgcttatgtacagaactgctgttactgttgcttggcaactagaagagatttgacaaggagtctaaaggaactgaatgaataaatggaaatgtcagcctcagtttcaggggataagaagaaatttactattgtaggattagcatcgcattgctttttccaggctacatgatcggaattcacagtgtttctctcctgcttctcctgcctctccacccccactccttccagtctttcctggtagcccctgtgcactgcagctgagaggtatatataagatagatggttaatgctaaagaatacaagagcatgtc

SEQ ID NO: 35589 - DNA, 250 bp, Homo sapiens
ccccttcggccgtcacgccggcgatggcggcgcctttccctggccccagccctggaagtcagcgggcctaagagcggccgtccctgagaggctccggacggccgaggcgccgagaggagacagccggagcgcgacggggtgtgtgtacattcgaaactccactgaaccttgattgaagacctacagtgtggcagtccatggcctggggactgattcaacctcatcttccctaattcaatgacactcgacg

SEQ ID NO: 35590 - DNA, 219 bp, Homo sapiens
gccattctcctgcctcagcctccccagtagctgggattacaggcgcccgccaccacacccggcaattttttgtatttttagtagagatggggtttcaccgtgttagctaggatggtctcaacctccagacctcgtgatccacccacttcggcctcccaaagtgctgggattacaggtgtgagccaccacgcccggcctgctgtggtctctaatgagcca

SEQ ID NO: 35591 - DNA, 172 bp, Homo sapiens
ccttggtaattttattggaaaatgtctgtgtgtatgtgaaaatgtacgtatgtgtttttgtgtgtgatgtataaaataaattataaaatattaattactttataaaatacaaactacatcaaattcatgtctgctgaccatctagaaccttgaatttttttttcccccgaca

SEQ ID NO: 35592 - DNA, 205 bp, Homo sapiens
ccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggcctcca

SEQ ID NO: 35593 - DNA, 168 bp, Homo sapiens
  misc_feature 124: r=a or g
  misc_feature 130: k=g or t
  misc_feature 140: k=g or t
  misc_feature 145: y=c or t
  misc_feature 147: k=g or t
  misc_feature 151: y=c or t
  misc_feature 155: k=g or t
tagggttcttgtagctgtttatgttaatatggagaagaaaactatattggctgattttttctgatcttaaagcagaatgccttttctttttttgcttcagttgtaaagaagagggaatacatgrtaaagkaactgggttkgattyckcgtycatkgtacactgcccta

SEQ ID NO: 35594 - DNA, 381 bp, Homo sapiens
  misc_feature 133: k=g or t
aagtgatcttaagcaagttacttaacctttcggactcagtgtccttatctataaaggggataattggacctgcatcttagagttgttgctaggattaaatggggtttaaagaaagcccttagcacattgcttkgccatatagtaaatcagtgcctgtaacagtgccaggcacatagtgggtgtttaatatcttttgaatgaatgagagaggagcatagctttggagagctacatgtagagttaaacctgggccttaattctagctctccatttagtagtagtatgaccacgggtagatcacttcggtttccttatctgaaaaatgagtttttaggattagagactgtttataaagtagctggcatgtgttaggcccggagc

SEQ ID NO: 35595 - DNA, 86 bp, Homo sapiens
aattcattttctttcagtccttggtggagatgctttaaaatcattgcatttgtttttgtgaaaggagttctgagcttttttttttt

SEQ ID NO: 35596 - DNA, 276 bp, Homo sapiens
  misc_feature 132: w=a or t
tttccagttaatgcatttggccctattgaattttcagggaccagaaaacattaaaaagttctgcatcttataatggtaaccaattaagcttgagattgttctgaaagtatcaattgctttaaaactgttgtwaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgctta

SEQ ID NO: 35597 - DNA, 76 bp, Homo sapiens
aagaagaaaaagggtgaccgcactgcgcaggcgccctcggcgtctctctcgctctctcggtctttttttttttttt

SEQ ID NO: 35598 - DNA, 382 bp, Homo sapiens
  misc_feature 129: y=c or t
agttatagtaccttcctgagaaggtaaagactaaacgagacggagtttcactgttgttgcccaggctggagtgcagtggcgtgatttcagctcacggctacctctgcctcccgggttcaagcaattctyctggcctcagcctcccaagtagctgggattacagatcatgaactggcagccatgtggaaagaagactagactgcgaatcacttaggatcccgccctcggtttagtctagaatactctgcgaatcagctttttggccctagtggatgacaagaactgagacaaatcaccaatgggcacaaactacccattcagcttacatatgatgccctataaaaaaacatagacaatcaagaattaacaaaagagagaaccg

SEQ ID NO: 35599 - DNA, 174 bp, Homo sapiens
  misc_feature 81: s=g or c
  misc_feature 124: m=a or c
catgtttatttgaaacaagcaaccaaacagcaatgaaaacatattgattgtttccagtctctgggccgaagtattgcgaasatttgaaaagctttcacgatttgtgtagatgattatgaaggamctgcttgttgcaagagaacatcagtgatttttttagttactcaccaaggc

SEQ ID NO: 35600 - DNA, 252 bp, Homo sapiens
  misc_feature 128: w=a or t
caagattcataaatactgtataactccagaagattagaacataatgttaaatcacattagtccttacaaacttgttttttctacctttgaaattgccacttatacattagttttttgaacattacaawttgatcaggatatataagctatgagacttatgaaccacgtttaaaatttgtacaaaagattataaattttacaggtgatttcacaattatggcatgagtttaaatttgattatatgtgggcgtc

SEQ ID NO: 35601 - DNA, 479 bp, Homo sapiens
  misc_feature 129: m=a or c
  misc_feature 340: y=c or t
  misc_feature 341: y=c or t
  misc_feature 342: k=g or t
tattttgtgcctttgacaaattaaatctaatagtggaaaaatgtttcttaattaagcactttactagtgaaaaagatctcacaatttatgccaaatcaggtactgtattttcatgtattaacacataamctttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaatyykatcattgtggaaaaatgtgtactaactcctgattttgttaattttataacataggttgaattttagagtggggtttttataagtaatggaggataaaatgggtgggagaaaatggcacacagcacctgaagaaagat

SEQ ID NO: 35602 - DNA, 125 bp, Homo sapiens
  misc_feature 5: k=g or t
  misc_feature 6: k=g or t
  misc_feature 7: r=a or g
  misc_feature 17: r=a or g
  misc_feature 124: h=a or c or t
ccttkkrattttgattratattctgtttggggcaagcagacttacattatatctatatataaatatatatgtaatgttttctatttgtttatttggaacagataaaatgatctcagagcccachg

SEQ ID NO: 35603 - DNA, 218 bp, Homo sapiens
  misc_feature 141: y=c or t
gcagaaacctggaaggcttcctgggcgggggatgctgagcagagtcttgaaggcctgatgggatttaggagaggaggattgcagaagaggtagcacaggcggagtgcagcggaggcccctgccgctgccgtcatggcgttycccggtttgggaagtctcacaaatctccagcagacattgtgaagaatctgaaggagagcatggctgttctggaaatt

SEQ ID NO: 35604 - DNA, 163 bp, Homo sapiens
ccttttgagggagcagctcggatggtggcgtaacctcgcaggccctgggcaggggctccggggaattcctggccaaaagtactttaatcagcatttaatgacccagtcgaaaattcattgtttggacccaagcactggtgggaaaaggcaggaggggaggcca

SEQ ID NO: 35605 - DNA, 448 bp, Homo sapiens
agccagtaatatttattataatcctagtgagtgagttgttgagcagctaattctttgctggccactgggcctaacctcatagatggagtggtgtatctctggagctagactgcctggggtgaatcctgtatcctctgcttagtcatgtcatcttggacgtttttcaacttcgctgaccttctgtaaaatggggatcacaacagtccctaccttttagagctgtgtgaattattaatccatgtaaagcacttggaatagcatctgacatgtcagtggctccatacacatgtatataatgttggcagagtcagttacagtcctctgactacttttctatggtgggaactttattattccatgtttaacagacaaggaaaccgaggcacagacaggctaagttactggcctgaactttcaaagacagttaagtaccaaggtggaatttgaa

SEQ ID NO: 35606 - DNA, 171 bp, Homo sapiens
aaaattagccagatacggtggcaggcacctgtaatctcagctacttgggaggctgaggcaggagaatcatttgaacccaggaggcagaggttgcagtgagccaagactgtgccactgcactccagcctgggtgacacagcaagactccatctcaaaaaaaaaaaaaaaaaa

SEQ ID NO: 35607 - DNA, 319 bp, Homo sapiens
  misc_feature 142: k=g or t
  misc_feature 202: r=a or g
  misc_feature 209: h=a or c or t
  misc_feature 210: y=c or t
  misc_feature 232: w=a or t
  misc_feature 233: m=a or c
  misc_feature 285: r=a or g
  misc_feature 303: m=a or c
gaatagtctaccccccttgcactctacctgacacagctgcagcctgcaattcactcccactgcctgggattgcactggatccgtgtgctcagaacaaggtgaacgcccagctgcagccatgaagatctgtagccctcaccckgctctccttcctcctactggctgctcaggtgctcctggtggaggggaaaaaaaaagtgargaatgghyttcacagcaaagtggtctcagwmcaaaaggacactctgggcaacacccagattaagcagaaaagcaggcccgggracaaaggcaagtttgtcmccaaaggccaagccaa

SEQ ID NO: 35608 - DNA, 139 bp, Homo sapiens
  misc_feature 132: w=a or t
  misc_feature 138: m=a or c
tcataacacttcatgcatgcatttatgtagttgttatattactttatctttagtaacttgtgtttgttttggtagctgccttatgggtaggcttattcacttttgtatcactaatgtctaaaatagcatttwacaacma

SEQ ID NO: 35609 - DNA, 169 bp, Homo sapiens
  misc_feature 136: m=a or c
  misc_feature 137: s=g or c
ttttttccttcttccttcccctcctcgccgccaccgcccaggaccgccggccgggggacgagctcggagcagcagccagagtttattaaccacttaacctctcagaactgaacaaagacaacattgttcctgggamsgccctctttttaaaaaagaaagcataacccct

SEQ ID NO: 35610 - DNA, 59 bp, Homo sapiens
cagtgggacctagattagaccatgaacgagccaagtccttaatggatcagtactttgcc

SEQ ID NO: 35611 - DNA, 128 bp, Homo sapiens
  misc_feature 116: s=g or c
  misc_feature 125: b=c or g or t
atcttttcacatgggcctctcccaccatcgggtctcagccccatcttctctctctctctctctctcggcctccctcattatttctccctctccctccgcctctccatctctccttsctccccctbccc

SEQ ID NO: 35612 - DNA, 169 bp, Homo sapiens
  misc_feature 3: v=a or c or g
  misc_feature 20: m=a or c
  misc_feature 126: r=a or g
  misc_feature 136: m=a or c
  misc_feature 137: v=a or c or g
  misc_feature 138: w=a or t
  misc_feature 141: w=a or t
  misc_feature 149: h=a or c or t
  misc_feature 150: k=g or t
  misc_feature 151: d=a or g or t
ggvagaagtatggagttaamgactgcagcgtgaactgaggagtcccggacaggccgcttgctgcagaggatccagtccagatcccaggagagcccctctgccccttcggacctcgtctcccatctrcaaaacgtgmvwgawtggcccahkdggcgtgtctctacaaaaa

SEQ ID NO: 35613 - DNA, 458 bp, Homo sapiens
  misc_feature 243: m=a or c
  misc_feature 244: w=a or t
  misc_feature 405: w=a or t
  misc_feature 406: d=a or g or t
  misc_feature 407: n=a, g, c or t
gcagcaggcagggagcccagcaaagcccatgtaaatgatctcaaaatacctcaaaaattaccaaatagaggtaattacatgaagcagtgtgtgaaatgagcacgatgaggatctaaaacagctgattgcatgctaaatggccattttgtaagtttaatgaagtaacatatcatttgacacaggaacaaaagaaaacaatcaaaaaacactctgggcacaggagagacttcactggcttccctmwcccaggcctgggtgtctcctgcacctacgggcagtgcttgtgaagtgcttttagctagtctgtggtctttgctcaaaagggtcttcattttctcttaaaggctgactactgtgtccccagctctgggtcggatgtcccacttgctcgggcacagtaaggtwdntgggttttaatggtgcatgaaattcttctggggtctttttgtatcttctga

SEQ ID NO: 35614 - DNA, 142 bp, Homo sapiens
ctcaaactcctgggctcacgcaatccacccacttgggcctcccaaagtgctgggattacaggcgtgagccaccgcacctggcctgatcataattcttaaaaacgcagtagttgccctcttaataatgacttgtgcttgccca

SEQ ID NO: 35615 - DNA, 118 bp, Homo sapiens
gagcgcggcccctgggttcgaacacggcacccgcactgcgcgtcatggtacaggcctggtatatggacgacgccccgggcgacccgcggcaaccccaccgccccgaccccgaccgccc

SEQ ID NO: 35616 - DNA, 229 bp, Homo sapiens
  misc_feature 128: k=g or t
  misc_feature 134: k=g or t
  misc_feature 135: k=g or t
  misc_feature 150: k=g or t
  misc_feature 187: n=a, g, c or t
tcctattgtgtcgtgtagcttgttctctattttataggtcatttaaaataaaactcacctttgactttgtttagtctctgttacatgtttgctttttgtttcgtttatgtttgtacatttctcatgtktttctkkctatgtcttttggtkgtattctaacttttagagtctctttattgggatgtcntctagcgataaatataaatacatttccctctaacaaccactt

SEQ ID NO: 35617 - DNA, 229 bp, Homo sapiens
  misc_feature 122: k=g or t
  misc_feature 123: k=g or t
  misc_feature 135: k=g or t
  misc_feature 147: k=g or t
  misc_feature 168: n=a, g, c or t
tgtagtgaataaagtttgagaaccactgacttgaactttagcatgatttgatacacagggtcctctgtaatcgtacttcgttctgctttaaggctgttgggctgtctcctccaacccatcckkatgttgttgtaktttttcacctckgtcctttggcttacgtcaccntcccaacctaatacctgcccttctagtcttctgtgtacttatccaaatctaaaccctccat

SEQ ID NO: 35618 - DNA, 133 bp, Homo sapiens
cacatctcactaatctttgtttatttagcccagttcctaacatgtattagttgttgaggagataattgtttgtattgaattatgacatcaaaacaaaggaacgggaagataaataatttattcaaggccactt

SEQ ID NO: 35619 - DNA, 429 bp, Homo sapiens
  misc_feature 96: r=a or g
  misc_feature 139: w=a or t
  misc_feature 140: r=a or g
  misc_feature 143: r=a or g
  misc_feature 151: r=a or g
  misc_feature 152: w=a or t
  misc_feature 155: r=a or g
  misc_feature 172: r=a or g
  misc_feature 255: w=a or t
  misc_feature 256: w=a or t
  misc_feature 300: w=a or t
  misc_feature 301: m=a or c
  misc_feature 314: r=a or g
  misc_feature 321: m=a or c
  misc_feature 322: m=a or c
  misc_feature 367: r=a or g
  misc_feature 377: d=a or g or t
  misc_feature 409: m=a or c
  misc_feature 410: w=a or t
taagaattttgtaggagttcaccaagtgtttgagatggttagtgtattccatacagagggaacagtaactgcaaaggcagggaaggtatgagagarctcagtatgtctagggaactgcaagtaattgagtatggctggwratrgtgtaatrwttrtgtttgggtatgggtarcaagtggcagaaaatgagactggaatgataagggacccaattatactgaaccttgttttaacttttttgttcacttataaatwwcacaaacatgttttgaacgcctatgtatctgtcactatgtgagwmactgagataggcratggttmmtggtgtaacagaacttacagtgtcctgaatggtacagacaggtaracaattgtadaatagagcagggagtattataaaccaaaggcmwacaattgctctgagagctc

SEQ ID NO: 35620 - DNA, 211 bp, Homo sapiens
aagcctgcaactacttctaagtgaagtggagcactattttttttttcggtattcaacttaaaagatctctggccagcagactaaaatgtttgttttataattgcccgctgaactatgatagtttgtttccagatggtgcccttccttcaacctgcacacaatctctccttgttcaaaactattcaacctcctgctgatcccacccccccgc

SEQ ID NO: 35621 - DNA, 176 bp, Homo sapiens
  misc_feature 141: m=a or c
ctctctataaaatgaataaaatgtttaagaaaagagaaagagaaaaggaattaattcagtgaaggatgattttgctcctagttttggagtttgaatttctgccaggattgaattattttgaaatctcctgtcctttttaamctttttcaaaataggtctctaaggaaaaccagcag

SEQ ID NO: 35622 - DNA, 66 bp, Homo sapiens
  misc_feature 14: r=a or g
  misc_feature 15: s=g or c
agtccgggagcgcrstgggccgcggcgctccgacctccgctttcccaccgcccgcagctgaaagca

SEQ ID NO: 35623 - DNA, 93 bp, Homo sapiens
cacgaagaaattctttgttacaagctgctatccatgtccagggccaaacatgaatcctattgctcttgggagccgctggcttgcttatgcaga

SEQ ID NO: 35624 - DNA, 245 bp, Homo sapiens
  misc_feature 139: s=g or c
  misc_feature 151: r=a or g
  misc_feature 156: k=g or t
ctcgtgatctgctctcctcagcctcccaaagtgctgggattacaggcgtgagccactgcacccagccggtaaattaaaatgtattttattattatttttttttttgatacagagtcttgctctgtcaccaggctgtagsacaggtggtgtratctkggctcactgcaacctccgactccctggttcaagtgattctcctgcctcgactccttggttaaagtgattctcctgcctcaacctcccac

SEQ ID NO: 35625 - DNA, 204 bp, Homo sapiens
  misc_feature 141: s=g or c
tccagtacagtccacgttgtgtaacagtggttaacagcatgagctttgggatcaaagtgctgggtacaaaagccagctctaccttgggtaattctgcataagacatttaatctgctgttcctcagtttcctctctcctgcstgttgggcaacagggcatatctggtagtggggctgtgagtattaaatgagataaatcgcacag

SEQ ID NO: 35626 - DNA, 362 bp, Homo sapiens
  misc_feature 132: m=a or c
  misc_feature 138: w=a or t
cattgttgaagaagcacagagttcagaagactttaacatgggctcttcctctagcagccagtatactttctgtcagccagaaactgtattttcatctcagcctagtgacgatgaatcaagtagtgatgaaamccagtwaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaaggc

SEQ ID NO: 35627 - DNA, 487 bp, Homo sapiens
  misc_feature 129: w=a or t
  misc_feature 137: w=a or t
  misc_feature 140: y=c or t
  misc_feature 141: y=c or t
  misc_feature 162: b=c or g or t
  misc_feature 206: n=a, g, c or t
  misc_feature 214: w=a or t
  misc_feature 487: m=a or c
ttcttccatccagagaaagcagaattccctcctagtaacctcattacaaatactgttactagaagggcatgtgctgtctgtcaccttcagtaatatttgtgccatctcttgatgactgatgacctggawcggagtawttyytatgaaagggtcttcttaggbcccttacatacgcaagaggggtgctctagtgccatagctgtagntcacaggwaggacaccaggagaagttatacctagggctactgagcagctcatcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagatm

SEQ ID NO: 35628 - DNA, 320 bp, Homo sapiens
  misc_feature 132: r=a or g
taaaaatacataaattatatacattttataaaaattattctaagagaacagaaaagaaaacttgttcccccatttcattttaagaggttagtataacctcaatatcaaaaccagacaagactacagtaaaargtaaaattataggtgccacacatagataggaagagatgaatagaccagtaggtccaagcaggccagatgtaagacaccaaaagcccaacatattaaggaataggataggaaaatgtatgatagtaagatttacgtaaaattatctgtattacaaagggtataataagtgaccagacaagaggggaggg

SEQ ID NO: 35629 - DNA, 445 bp, Homo sapiens
  misc_feature 129: k=g or t
  misc_feature 364: m=a or c
catgttttttgaatttcttaattaagtatcattttgtgttaagcttagaagactgagagctgaggagagtggacaaataaatgttggaattaggaaagttacatgaaggaaagtgggtctgagctgggkttttgaaagtaggcagaatttagatcagtagagcaaagaggataggatagtctaaatgtggagaatgctgtatgaatggaggcagaatatgtattgaacatgaggaaccatcaagaggccggctcagtgagggaagaagggggcttctggaggcaccataggtagacataagacattaacagattattgaccaacaggcaggggaggttaatatgctccaatgataagagcatcmtatatttataatggagactaacaggttgatgttgctgagaaaataatatggactttgcattcaatgatgtatcttttcaca

SEQ ID NO: 35630 - DNA, 245 bp, Homo sapiens
  misc_feature 131: r=a or g
  misc_feature 137: r=a or g
  misc_feature 138: r=a or g
  misc_feature 142: s=g or c
  misc_feature 221: s=g or c
  misc_feature 222: s=g or c
attcatcaaaagaggctttcgctcccggactcccctgggcctcgagcagaaagcgtctcggccacggagatacagaaccgggagccttcaaggtcctccgccactctcagcaagccctgctctcgatggaraaggarratcsgctgggtgatggatgtgggcttccagtaaggtgctcgcgctggtcccgagccctccggggaagatattcgagcgcggasstaagcgcagggcacgccagcccc

SEQ ID NO: 35631 - DNA, 405 bp, Homo sapiens
  misc_feature 129: w=a or t
  misc_feature 133: r=a or g
  misc_feature 135: y=c or t
  misc_feature 202: s=g or c
ctggtgcggtggctcacgcctgtaatcccagcactttgggaggccaaggtgggtggattacctgagcccaagagatggagaccagcctgggcaacatggtgaaacccctctctactaaaatataaaatwttargytgggtgtggcgacatgcgcctgtagtcccagctactcttgaggctgaggcagaattgcttgaacctsggaggcggaggttgcagtgagccgagatcatgccattgctctccagcctgggcaacagagtgagactccatctcaaaaaaatttaaaaaaaagtttatcatcaggctcttcattttttggctgttgatttttttccttattttgagagtaggcctcaaagagcaggaaggctattcttgattaggcgtacttcagggcaacac

SEQ ID NO: 35632 - DNA, 291 bp, Homo sapiens
  misc_feature 123: y=c or t
  misc_feature 127: y=c or t
  misc_feature 129: m=a or c
  misc_feature 134: y=c or t
  misc_feature 268: k=g or t
  misc_feature 269: n=a, g, c or t
  misc_feature 271: n=a, g, c or t
cactctaaaaaggcctggcaaatcaagatgtgtttgcatgaaactaaaggcactaggaggagactaaaaggtcaaatctaccttttaggtgcagcctgcattccaaatggaggcatttcagcytacycmaggtycttaatttagtctaaccacttggcaacctactttatttagtttaatctcctggcaacctactctaaccacttggaaacctacagcctacatacagaatcatagttcagccatccattcctaccttcctagtgtkntnagtttatttgcttggctcat

SEQ ID NO: 35633 - DNA, 63 bp, Homo sapiens
  misc_feature 56: s=g or c
agtgaggaggtggttcttgcccgtgttgtgtgtgtgtgtgagtgagagagcgagtsagtgagt

SEQ ID NO: 35634 - DNA, 157 bp, Homo sapiens
agaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaaggg

SEQ ID NO: 35635 - DNA, 409 bp, Homo sapiens
  misc_feature 137: r=a or g
  misc_feature 139: r=a or g
  misc_feature 146: v=a or c or g
  misc_feature 362: v=a or c or g
  misc_feature 370: r=a or g
  misc_feature 385: m=a or c
cagcttaggggtagggaggcagacacagtcttgtggtaagcctagcagagagtagttcagcgtacaggatgtgagtccaggaaaatgtgaaaacttctgccacagtcattctattctgtaggaaatgaataggatgrtragaaggvcaataggatcattgttcttgcccctacatcacaaaacaatgacaagttcataaggcagaactcactagatcacacaggaagttctttcgatagacaggcatggatgattttctggctaataggacacctgtgtgcacacaagcatatatagagttaaagcacttttgctcatgggaagtataatttgagaagatggcatagggtgtgagccaccavtttctagrttgctaggtggttamctcccaattagactttatctgggt

SEQ ID NO: 35636 - DNA, 305 bp, Homo sapiens
  misc_feature 135: r=a or g
  misc_feature 136: w=a or t
  misc_feature 142: r=a or g
  misc_feature 176: h=a or c or t
  misc_feature 177: h=a or c or t
taaatgtagatgtgctaaaatatatagatctatcatattttacctacatatgtatgtcattccagtataaaacattctcctctacccaagaaccatagccatgattgttataaatcaatgaagtgtaaacatacrwtaattraaaaaccacttctgacattccattatgtgctathhaaagatggactattgaactatagaaaagacagactgtgcatttgttcgttgatcctcatcttattcctgacatgtaaaaatcaattttacgtagagtcaacattgtaggtagattaaaataccagtat

SEQ ID NO: 35637 - DNA, 132 bp, Homo sapiens
  misc_feature 128: r=a or g
ttatttaaaaaaaaaacaacagcaacaaaaaatcctagcctccagttgccttttcctttctttagctcctgtttttggtgaattactaaactgattgactttcagcctttttggctagatcctgaaargcac

SEQ ID NO: 35638 - DNA, 333 bp, Homo sapiens
gtacataatggccacgtaagtgttctgtggtgcttattccacccattcccacgtaggaaatgccaccaaacatgacctctaaaggaatgtattacgtatccattttcctttcacaatttttccccaaatggaagttgtaatattcagaatccaatgtatatcttagaatctggatccactttgctattagagtctgagctaacttgaggatggagagaaaagggaagtgaagaagaagaagaggaagaggaagaagaagaagagagatcatcaacagtttcatattcactagagcatcagccaaactgtaagagctgaccagaacccactgcc

SEQ ID NO: 35639 - DNA, 244 bp, Homo sapiens
  misc_feature 125: r=a or g
  misc_feature 142: r=a or g
atgaattgaggaagtgaaagaaggcaaggaggtaggaagagagggaggaggaaaggaaggagagatgcctcaggcttcagaccttacctgggttttcagggcaaacataaatgtaaatacactgrtttattctgttactagratcaggttttagggtcctgcaaaaggctagctcggcactacactagggaatttgctcctgttctgtcacttgtcatggtctttcttggtattaaaggccaca

SEQ ID NO: 35640 - DNA, 504 bp, Homo sapiens
  misc_feature 263: w=a or t
ttgtagagatgagctctcactatgtcacccgggttcgtctcaaactcctgaaccctagtgattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcawgattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaaggattgccaaggacttctaacaataaactctcttttgcaccacagacacaagggggatcacta

SEQ ID NO: 35641 - DNA, 196 bp, Homo sapiens
ccaattttctgaatactactttgagcattacacaaagcatgatgtggcgtgccatttactctgagttctactttactattcatttgtatttctatctcttatctgcaggtatggcatttcaaatatagatacaaccattgaaggaacgtcagatgacctgactgttgtagatgcagcttcactaagacgacagacc

SEQ ID NO: 35642 - DNA, 274 bp, Homo sapiens
cgcttttcctaataagatttagttaattttctttaataaacatttctacatcttcagtatgttgttaggataccttccagacactttaaatggttgttgtttttacaattttcattatttatagttgttttgctgggaagagtgtccacagagcttctcataccacctttgggaagtgcttctccttaacatgatgaattagcctcctatggctgctttaacaaattaccaaaaacttgatggcttaaaacaatacaggtttattctcccacgc

SEQ ID NO: 35643 - DNA, 189 bp, Homo sapiens
ctaaaagattgggtaagaaaaaaagtaatgatcttgtaagattattaaaaggttttggtattggtaaaatgtgtttgactaggagatgattgcatcaagaatctctaggatttctgtatatttcaagtatttcattagcaaaagaattttaaaaagaaaaaggatcgatatccagattaagaggcctct

SEQ ID NO: 35644 - DNA, 200 bp, Homo sapiens
agaatggttaatctgtggagagaaacatgtttagatgctgctaaatatctgggaattccatgccaagtgtagctggagaatgattcgtgatcatgaatcacgaggtgaaaacaaggcaggacttcctaaaggtttctgtattacttttctgcaaatataatccactcagacattggtttcatcattatatactgggccct

SEQ ID NO: 35645 - DNA, 375 bp, Homo sapiens
gtagagaggcctccctctgggatgttacaggaagataaagtaccaggattaatttgtgttcaatacagaggtctttctttaaagaattttaaaatgtctatgcatggaacattgaaaagtattgaagggcctccaaacttgggtataaacttgcctttgagcattaagcctgcaactcaaaattcagcaaatcagaacaaagaggacaccaaatccatgaatggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacggga

SEQ ID NO: 35646 - DNA, 201 bp, Homo sapiens
  misc_feature 126: w=a or t
  misc_feature 130: m=a or c
  misc_feature 132: y=c or t
caacaagtgtaccaaggccattcaatggggaaagaatagtctcttcaaaatatggtgccgggacacctggatgtctacatgcaaaagaatgaagttctaccccttcctcacaccatacacaaatawttamcycaaaatagatcaaagacctagatataagagcttaaaccatacaactcttagaaaagaacagaggggcag

SEQ ID NO: 35647 - DNA, 118 bp, Homo sapiens
aaattggaggaatcactctacctgatttcaagacttattgtatagctccagtaatcaagattgtgtaatattggtagaaggatagaccaaagatcaatgaaacagaatagaaaagcag

SEQ ID NO: 35648 - DNA, 410 bp, Homo sapiens
  misc_feature 372: w=a or t
ctatgtaactacacagtatgcacaccacagccatgtcagtgtcacagatcctcttgtgcattcagctttcttaaaaacacatcaaaggctgcaaagaagctcagaaaaaataaattgaaggacaggtggaatacaatgactctatgtgaggaacttgccaactcacatctttcaaagccagatcagcttatatagtacatgcattatagtcatatgaaatgttgtcttggtgctttcttcttggaggactatggcagcagctttaagactactaacaaagattattacacaggtcatcttatccacaggcaaactgctttgcacaactagaacattaacagttctttttaagttaagttcagatgaaactgwcacaagacagacttgatgtattttatatataccggggt

SEQ ID NO: 35649 - DNA, 480 bp, Homo sapiens
  misc_feature 139: r=a or g
  misc_feature 321: n=a, g, c or t
ttcattttcaaaccaaggtccaagaaactggagacattgtcatttcaaatgcatatgtggatcttgcaccaacatctggtacttcagctaagacaccctctgagggcgggaagcttcagagtacctttgtatttgaggraataagacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatacttncagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactatta

SEQ ID NO: 35650 - DNA, 87 bp, Homo sapiens
aacagacctcaattacaacccttataaagctgggttgtggtcgggtgcggtggctcatgcctgtaatcccagcacttcggaaggccc

SEQ ID NO: 35651 - DNA, 136 bp, Homo sapiens
tcccgtacgagtttgggcccatcacctaggtacttctgaataagttcagagccaaccactctcaagaaagtggctgaggtttggtttgctactgctttggctaacaaggttttacctattttggatgaaaaagata

SEQ ID NO: 35652 - DNA, 307 bp, Homo sapiens
  misc_feature 134: r=a or g
ttttcttcatttgtgatgctcagattcaaaatgtgtgttctacactgttacaggcttctcttttgtttgattaaagattttagtcctacttttgtatggacacattagaatattcagagaccaaaattagaagraatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctca

SEQ ID NO: 35653 - DNA, 211 bp, Homo sapiens
  misc_feature 115: k=g or t
  misc_feature 122: k=g or t
  misc_feature 187: d=a or g or t
catcccaaacagaaactctgtactcattaaacagtaactccctgtttccccactcccccttgccccagacgctagtaacctccattctacttcccctttctgtgagtctccctgktgtagckaactgaatgtaagtgaaatcagaccatgtttgatcttttgtgtctggcttattcattagcatatdattttcaaggtttatccatgctgc

SEQ ID NO: 35654 - DNA, 50 bp, Homo sapiens
agaaccctccaagcagacacaatggtaagaatggtgcctgtctgctgtct

SEQ ID NO: 35655 - DNA, 397 bp, Homo sapiens
  misc_feature 57: s=g or c
  misc_feature 94: m=a or c
  misc_feature 95: m=a or c
  misc_feature 149: s=g or c
  misc_feature 164: k=g or t
  misc_feature 175: m=a or c
  misc_feature 228: v=a or c or g
  misc_feature 258: m=a or c
  misc_feature 283: n=a, g, c or t
  misc_feature 295: k=g or t
  misc_feature 301: n=a, g, c or t
  misc_feature 302: v=a or c or g
  misc_feature 313: b=c or g or t
  misc_feature 314: n=a, g, c or t
  misc_feature 330: n=a, g, c or t
  misc_feature 331: s=g or c
  misc_feature 337: m=a or c
  misc_feature 340: s=g or c
aacctcaggtgatctacccgcctctgcttcccaaactgctaggattacaggcgtgascaccgcgcccaacctctggaggcatctttctaaaacmmatctgatctaaaattgctattggttccccaatgccctcgggataaaatgtgacsatccagtcgcaagtkactctgaaggmcactttcctaacacctctcttttcccattttcctacctctgcagctaacacavttcccttgacatttcagcttgtctgctgamgtttttcctcccaacagtcgcaganttctttgcctgkaaagcnvttctcggcgtbnctaacatcccactctnsctccgmcasgaacaggttcagcctcccctgcaggctgagcgcctgcactacgcgcaggctgagccc

SEQ ID NO: 35656 - DNA, 245 bp, Homo sapiens
ctcccaaagtgctgggattacaggtgtgagccacggcgcccagcctaggccttattttcagagtggctttcacggatctagtagtgtaggcattatgaaataatatgatacttaatttcattgccattacagcttgatgtacatcaaacatcaatacataagcagttctctaaatgtattaaagagttgtaccaaagaaaaatcaatagacttatcttttaaagtctgaagtgattggggcaccg

SEQ ID NO: 35657 - DNA, 484 bp, Homo sapiens
  misc_feature 124: k=g or t
  misc_feature 127: k=g or t
  misc_feature 129: k=g or t
  misc_feature 134: k=g or t
  misc_feature 156: k=g or t
  misc_feature 444: k=g or t
tacttttcaggggtacagtttgacatgtactcttggagggttcctagaacctggacaaagtaatatttaccaatgtattttttcccctcacataaaaaaaagtagattcagtgtgaatttacakttktkaactkaataatctatctaaaatatttkttcatgttaatacatattgttctgctataatctttttaaggactgcctgttattccactttattaatgtattttcacttaacctgactcctgttgatggacacttagatcttcagtgttgcattactgtatacagtgctctaaggaccgtccttctttgggaatgtctgtcagtatttagcatattgattctccgcatggaacctggtcacagtgccctccaggtttgtactactgtgatttgatgaactacttcagcagttctgatttgggttgccacaataataakgcagtgaaaatgtgagtttctggcaatcagggggatctac

SEQ ID NO: 35658 - DNA, 468 bp, Homo sapiens
  misc_feature 440: w=a or t
caaatttgtctagaatagttgtcccttcaggtttaacgttagacgtaagtgtcctgaattacatgactaccttagcactaggttacaaagggagtctgtcaaatttatacatcagctctgtttgcaggaattgtttcaatgtatccccattactgccttactaatttaggatctttaacaacttaggaagaccctcacagaatttttatttgctgaataagcagatagctgttagatcaaggagaagatggttttaggcaacaaaggttaactgttctttccctaggagagtgcctaaaagggcagagaaaaaaaagaaaagtagtatgttgttaagctacatgttacccagttttctcatttttaaaggtatctttagttgttagatatatctttacttgaattacagtcttcagttgctggagggagatgagtgagtwacactaaattaagtgttagtatcattta

SEQ ID NO: 35659 - DNA, 169 bp, Homo sapiens
ttctaaaaaataggatactgctgtacatattgttttacaatctaagtcatataattataatattctttaagcatatttatgagtaaaatattaaaacctatacaaaaaaataatagaatggcattttagctcattcattgatttttataaaatatttaacacactccct

SEQ ID NO: 35660 - DNA, 460 bp, Homo sapiens
tatatatctaggagtggatttctgggtcatgggataggtgagtgtttaactttattagaaacgacagaggcaagaggatcgctttaacccgggaggcggaggttgcagtgagctgagatcgcaacattgcgctgcactccagccggggcaacagagcaagacccctcatctcataaataaataaacaaacaaacagacaacctagacatggcaaaaactagtataaacaaaattgggactccagtgataagctgggaagaaatagttgccatgcagcatgttcaaagggctaatttcctttaaaaagcaagatcgcttgctgatagaaaagaccaacaactcagtagacaagtgggcacattcagagacagttcaaaggaaagacaagtggctcctaaatgtatgaaatgatcctcagttgcagtcaatgtaagagttaagcaaattgaaactatactga

SEQ ID NO: 35661 - DNA, 383 bp, Homo sapiens
cagttgctctgattcatggtattttaagttctttccactttgcagagttaaatattaatgttttatcatagctttgtagggatgcttaagagcaagtgtttggcgtcagagagaccagggttcaaatcctgattcttcgactttatagccgatgagcactgggcatatggcaacgtctcttgagtctcagcttccttgtctataaactgtcgtagtggtgtttgcctcttgaggttttgagaaaaaaaaggagtttcttaaactctcatggtacataactagcatttgataaaattaatgtaatatttttcttttaaatacgtgtattagagaaaattttaacatgcaatagtcttaatgtgattagattatattgtgagccc

SEQ ID NO: 35662 - DNA, 133 bp, Homo sapiens
agttctgtccctgctaagggattagtgtttattagtaaatttctaaactagaggtttattatgaaggttaagtgaccctttattaatttgacacagttgtaagattaatacatagaaattatcactgagcaaa

SEQ ID NO: 35663 - DNA, 106 bp, Homo sapiens
tagtgaataaagtcattattaggaagttcaaaagcattgcttttataatgaacttgagaaaaacgtatgtgtgtgtgtttaattagaataaaattcctctaggcac

SEQ ID NO: 35664 - DNA, 146 bp, Homo sapiens
  misc_feature 130: s=g or c
  misc_feature 133: y=c or t
  misc_feature 134: y=c or t
agctgtctctgcggaccccgccgagggagggagagaagcgctaggaaaaggaagaggagaaggagctcgagcgggaggcaagcgagaggctcttttgctcctcccaaagcagggggcggctccactgtgsttyytgatgacccggc

SEQ ID NO: 35665 - DNA, 417 bp, Homo sapiens
  misc_feature 129: w=a or t
  misc_feature 130: k=g or t
  misc_feature 131: k=g or t
  misc_feature 132: y=c or t
ctttactgacatgcaggctaactgtgtagatatttcaaagaaagacaagcgggtcacaagacgatggagaacaaaaagtgtcagcaaagatacaaaaatacaactgcaggttcctttcagtgctaccawkkycaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcacccc

SEQ ID NO: 35666 - DNA, 71 bp, Homo sapiens
gggctgctctcgctataggggttctcgctatagccggtctccctacagccgatctccttacagccagccgc

SEQ ID NO: 35667 - DNA, 371 bp, Homo sapiens
  misc_feature 129: w=a or t
  misc_feature 131: w=a or t
  misc_feature 132: m=a or c
  misc_feature 133: s=g or c
  misc_feature 141: d=a or g or t
  misc_feature 142: v=a or c or g
cacagataccctgtcaaagggtgagacaaagttcatggtaagtacttgttagagttagcacatctaaaaaaaaacttggagactgttcagtagccattctgagtgtgtgacttcatggtagctttgaawtwmsagtcaccdvatagagtatccatgagactttaaagaaaaataatagcaggggccgggcgcggtggctcacgcctgtgatcccagccctttgggaggccgaggcgggtggatcgcctgaggtcgggagctcaagaccatgctgaccaacatggagaaccccgtctctgctaaaaacacaaaattggccgggcgtggtggcgcatgctgtaatcctagctactcaggaggatgaggcggga

SEQ ID NO: 35668 - DNA, 278 bp, Homo sapiens
cagaatgttgcagattgaaattaatgatgtgcctcacccccatccttcctgcccttttaatgctatggcttttaatctcagcccttccaaactataaatcaatataatttatagttgcttttttgtgtccagtgtattagagggaaaaaaccccacataaccttggcttgatgctactacattttccagcctcactagatctttaaattatgatcagtagtctatcaatttattctttaggccactttccagcatcaattccagccttcaccaccctt

SEQ ID NO: 35669 - DNA, 252 bp, Homo sapiens
cagacatgtcatatgttcaaaatgctcatggcaaacaatcattttgcattcctgcaaataaaattgttttatactgtaagctggaggcgagtgtaacttatttttgtaataaagtttttatttttttttatgtgtcattaatataaatgtgtgttagtgtagaaatcttctggtttaaaaacttagaattgcacacatttcagtatgtttatttgtacttacataattttagaatagtggttgccaatagcc

SEQ ID NO: 35670 - DNA, 190 bp, Homo sapiens
ataactcctgggaatcagcagggaggagaagatctagtagtgggtgctgcggacaccgacgtcagggttcaagatatatgttgggtaaaggaggaaaacggaagtttgatgagcatgaagatgggctggaaggcaaaatcgtgtctccctgtgacggtccatccaaggtgtcttacaccttacagcgcca

SEQ ID NO: 35671 - DNA, 298 bp, Homo sapiens
  misc_feature 223: n=a, g, c or t
tgaaattattagtgccttcttgatattcttagtttaaagaatctcataaaactttatgttttatgtgtctaacagtatacttatcccatagggggcttccagcttttcactcactcatcatatttctttttagataactcgacacaaatgaaaattttattttatctatttagcagaaaagtcacacaaagttcataactatttaaaagtacaccatatttantgagcataccttaaataattttgatgggacatttttagtctcattgcattatacagttttgatatcccctaccca

SEQ ID NO: 35672 - DNA, 260 bp, Homo sapiens
  misc_feature 45: s=g or c
  misc_feature 60: k=g or t
  misc_feature 61: y=c or t
  misc_feature 66: w=a or t
  misc_feature 67: k=g or t
  misc_feature 85: s=g or c
  misc_feature 111: w=a or t
  misc_feature 112: w=a or t
  misc_feature 116: s=g or c
  misc_feature 159: v=a or c or g
  misc_feature 199: n=a, g, c or t
  misc_feature 224: s=g or c
  misc_feature 225: s=g or c
aatagaacttgtctatagctgcggtgtcttctgctctgcagagasagagcaggagaccgkyagggwkaggcactctcagcagtasgcgcaaccgtgctcaccccgtgcctwwcagscttgcttagttccggggctccgaggcagcagcagccataagavaaaacaggagaggaaggcgatgtggcgcttctgccgggcnctcagactggggagtgtgaggtcassacaggctggcgtgtcgttttcgtctctgtggctgc

SEQ ID NO: 35673 - DNA, 56 bp, Homo sapiens
tatcatatctttaaaccaataatttgtcctcctttcatttcttgcctttcattttt

SEQ ID NO: 35674 - DNA, 178 bp, Homo sapiens
cattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaactcc

SEQ ID NO: 35675 - DNA, 174 bp, Homo sapiens
ccctagtatttctatcttactgctaaaatacaggaaaagtgccgtatttttaatgcatttagtggttttctttggtgttatctgttccatttttctttttcatacattgaagtgtgtctccttttcaaccaaataatgaaatagtggagaccatgaaattgttgtgcctggcca

SEQ ID NO: 35676 - DNA, 303 bp, Homo sapiens
  misc_feature 34: n=a, g, c or t
  misc_feature 121: m=a or c
gagaaaggccgagacggagggagccagcggcggnccgaggggctggtccaggcgcggccgctaagaggagaccaagaggcgggggctgcacttgacaaccagcatgccgagatggcacacmttgggcccaccccactccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaaggagg

SEQ ID NO: 35677 - DNA, 157 bp, Homo sapiens
  misc_feature 20: s=g or c
  misc_feature 133: r=a or g
  misc_feature 134: k=g or t
  misc_feature 135: b=c or g or t
  misc_feature 136: w=a or t
gtgtcgccgccgcccgcggstccccggtttggtgttgcggcgcccaccttcgggaggatcagtatctggcaccaattctgacccagtcatttgtgatccctggctcttgtgatatgctgaagatttccaggcrkbwttgtggaacacctccccgtcc

SEQ ID NO: 35678 - DNA, 192 bp, Homo sapiens
accgtgcaagtgtgatgtgacatagccttcagtggtcagtcaacacttattcaccatcaagcaatccatgtcatagggaaactttactaatgtaatgattgtcacaaagtcctcagtaatgctacaaccattgcaaattattggagaatgcataatgaagtgagaacttacaagtgttataaatgtggcact

SEQ ID NO: 35679 - DNA, 445 bp, Homo sapiens
  misc_feature 177: k=g or t
  misc_feature 178: v=a or c or g
  misc_feature 179: n=a, g, c or t
  misc_feature 436: m=a or c
aacctagacgcattaggaaatgcaagttttacctaaaacttgcagaaatttaaacacatttccatttacttactaacgaacagacctgatttttatttaaaaacacaatttagctttgccaacagaagagtaaggaaaccataacttataaatttgtaatgtgttcctccttgttgkvngacattagccagtgtttagttttagaccaacttatacaaacagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagcccctaacaatggcataatagtgaggtctctctgtgcatatacataatatatatgcaggmtaaatgtgt

SEQ ID NO: 35680 - DNA, 406 bp, Homo sapiens
  misc_feature 125: h=a or c or t
  misc_feature 137: k=g or t
  misc_feature 142: b=c or g or t
  misc_feature 145: k=g or t
  misc_feature 367: r=a or g
  misc_feature 377: n=a, g, c or t
cgaaatgttgaaggagttgaggaagttcatgaattacatgtttggcaacttgctggaagcagaatcattgccactgctcacataaaatgtgaagatccaacatcatacatggaggtggctaaaahcattaaagacgkttttbcakaatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagccaggaggrctaaagctgnaaacatccctgctgttgtgatagagatta

SEQ ID NO: 35681 - DNA, 433 bp, Homo sapiens
  misc_feature 142: r=a or g
  misc_feature 145: r=a or g
  misc_feature 146: r=a or g
  misc_feature 156: s=g or c
  misc_feature 262: n=a, g, c or t
  misc_feature 345: s=g or c
  misc_feature 347: s=g or c
cttcctgccgtcccccgcctgagggaggggagcggtgcagcagacatccgagggcagctgggaccccctgactcagccgacgggtgagtcaggctccctgcaggccacaccggacccccccagggcggggatttccccaagratrrgaaatcagcsaccggaagtcacgccggaccttggacgggcagacagaggctgggaggagttctgggtgcagagccccccaacctgtgctctcatctcttgctctggggtaagccantggccatgctataaggacactcaagccaccctatgaagaagcccacatgaagaggaactgagatatctggccaacagccagcsastcactgagcctgccaaccacgctgtggcaggtacctccagccccagacacctgcagcctccactgaaagctcaatggcagcctcat

SEQ ID NO: 35682 - DNA, 247 bp, Homo sapiens
  misc_feature 136: s=g or c
  misc_feature 139: r=a or g
  misc_feature 142: k=g or t
  misc_feature 150: k=g or t
  misc_feature 155: k=g or t
aggctgacggatgagcacgcagccaaccgtccaccagccttcctgattcttggctgcagggctctgctctggtttattggcagcaacagtggcggcttgtctgcaagaccttgaaacccacctttcaggagcttgstgragkcaaaagtkgtackgcatgaccacgtgggggaccaccttctggtagaggcatatgacctggagcaaaacagctttcaaaagaatggtttctgcatcatctgcaccg

SEQ ID NO: 35683 - DNA, 435 bp, Homo sapiens
  misc_feature 4: h=a or c or t
  misc_feature 122: s=g or c
  misc_feature 123: v=a or c or g
  misc_feature 131: r=a or g
  misc_feature 136: r=a or g
  misc_feature 141: r=a or g
  misc_feature 143: m=a or c
  misc_feature 159: s=g or c
  misc_feature 162: k=g or t
  misc_feature 166: r=a or g
  misc_feature 170: d=a or g or t
  misc_feature 173: m=a or c
  misc_feature 174: s=g or c
  misc_feature 194: r=a or g
  misc_feature 413: n=a, g, c or t
cgahaacaatgatctaaatctttcaatggcttccatctttctcagagtcatgtccttaaaagtcccataagggattaatgatcagaacctcagctcctccctctctgcctcttacagcatgsvtataccaracacrcatcramctcaagggccttttgsacktctrtgtdacmsatggaaggctgttgcacaarctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaantattgtttaaatgagtggatgc

SEQ ID NO: 35684 - DNA, 202 bp, Homo sapiens
gccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccaat

SEQ ID NO: 35685 - DNA, 119 bp, Homo sapiens
atcagaagagagctggggtagaagccccatgtttgtattccatgaaacacgtcgggttggagtaaaggcaaaaacagctagacacaccaggtgtgtctgtttgacatttataagccggc

SEQ ID NO: 35686 - DNA, 50 bp, Homo sapiens
  misc_feature 9: r=a or g
  misc_feature 10: n=a, g, c or t
  misc_feature 12: n=a, g, c or t
aagcgcagrncnagaaggagagggagagagaaagagagagaggctaatta

SEQ ID NO: 35687 - DNA, 146 bp, Homo sapiens
  misc_feature 38: m=a or c
  misc_feature 63: s=g or c
  misc_feature 142: y=c or t
agagcctaggaagatttgggggtcgccttgccggcctmctgtcctcctccggcggcggcggasccgagagaactaggtgaacaccgctttgccagcctcacacagcgtcccctggctctgccgccgctccggacgtttgccytccc

SEQ ID NO: 35688 - DNA, 448 bp, Homo sapiens
  misc_feature 135: m=a or c
  misc_feature 137: h=a or c or t
  misc_feature 310: h=a or c or t
  misc_feature 311: n=a, g, c or t
  misc_feature 344: d=a or g or t
cattctgatatattcagtttcccactttaggcaaaagtagattaatagaatgacgaattcaaagtagatgaggaaaatcaggcacagagaagtaaaggtagggatagacccaaatttacacaacaagataatggmahctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgahntttgtacatttcagggtcagatatacaatatgdactcttaatctacaggaatgagaatggaggatcattgaaggccatgatataaacaaatttgcatgttgaagcctgtataaaacatggtacagtgagtgaatata

SEQ ID NO: 35689 - DNA, 194 bp, Homo sapiens
tattttagggtttcttaggaggtaaaatctgcaggacttggcaatggattggaattgggagggagggagtgtgatattgtgaagtacacatttagtctttagtttgttttgtgctgctataacaatacccgatagtgggtaatttataaacagaaatttattgccttacagttctggaagataggaagtctaag

SEQ ID NO: 35690 - DNA, 411 bp, Homo sapiens
  misc_feature 123: r=a or g
  misc_feature 133: r=a or g
  misc_feature 137: k=g or t
  misc_feature 145: m=a or c
  misc_feature 234: m=a or c
  misc_feature 304: m=a or c
  misc_feature 313: n=a, g, c or t
  misc_feature 317: m=a or c
  misc_feature 318: s=g or c
  misc_feature 319: s=g or c
  misc_feature 394: m=a or c
atgtggagcagtgtacagtgaagcggaggcagagcggctccgcgagcttctctccactttcccatagagaaaccctgactggccgctgagggctagctacacacacgccctcacgcccggcgragcccggcgraggkcactatcmatatgacaaaggctttgccgcagttcatcttcctccctgtgtactttccatttgccttcctggaatcctgctgcatcacagaagctggmagttctgatgttccactgaaatcacaatggaaagtcttgacttgactggtcacagtaatgaaaggcagtmatagacatnaggmssattcagcagaaggagaaggggttggaaaacgaccaaaacgaaagtgtcttcagtggcatccattgctagcaaagmaacttcttgatttttca

SEQ ID NO: 35691 - DNA, 160 bp, Homo sapiens
  misc_feature 121: r=a or g
  misc_feature 129: v=a or c or g
  misc_feature 141: r=a or g
caagtttaaaagcattttgtggggtacatcatttctataattgtataatgtatttctttgtggttttaaatgataaagacattaagttaacaaacatataagaaatgtatgcactgtttgraatgtaavatatccttagarcactttcaatgggggttcc

SEQ ID NO: 35692 - DNA, 93 bp, Homo sapiens
  misc_feature 71: n=a, g, c or t
ccaatttatcggcgtagttcccctttacctccaaaaacactgggcaaattctcccatctaacctaatagcncctaactcctgcactctttggt

SEQ ID NO: 35693 - DNA, 208 bp, Homo sapiens
  misc_feature 79: r=a or g
  misc_feature 80: k=g or t
  misc_feature 134: r=a or g
  misc_feature 149: r=a or g
  misc_feature 151: s=g or c
  misc_feature 155: r=a or g
  misc_feature 159: r=a or g
aacttgagaggctgaggcaggaggatctgcttgagcctgtgctccagcctgggtgacagagcaagactgtgtcaatcgrkcaataaaacaaaaatcaactcggagaacaactctgctcatggtgattacatgcraaataacgaggagcrgsttartagrgcaagctccaatacctcaggacggacttaccgtggcacctcacagagca

SEQ ID NO: 35694 - DNA, 364 bp, Homo sapiens
  misc_feature 139: r=a or g
  misc_feature 142: m=a or c
tatcaatatttcaggagaaggccctaaagatttttttctttggccagtttgtttccaaatagtccttttaaccttgttttttgttttgttttgttttgttgtttttaaccaaaggtgtacctaatccaatgtaactcgraamccattaagactttttgtggccatggatacaagagatgttctcagagtcccccaggatccaaagttaccccacagatagccaaaagaaagacaagcgccctcagagctggtgatggctggtaggatgtcagctgtcgccgagtctgtgttgctataaagaaatacctgaggctgggtaatttatggagaagtttaattggctcatgtttctgtaggctttata

SEQ ID NO: 35695 - DNA, 132 bp, Homo sapiens
  misc_feature 99: s=g or c
  misc_feature 100: s=g or c
  misc_feature 116: r=a or g
ccttgagaggggggcttactcttttgatggcaagtggggacagaaggctaaagtacagcagctgttctctcagccctggtctggaggacatccaccacsscctttaagcttactargcctcctgttgctaat

SEQ ID NO: 35696 - DNA, 341 bp, Homo sapiens
  misc_feature 130: y=c or t
tagacttgagaggacttgcaagaaagatgttgaaatcaatggggtattcattcccaaagggtcaatggtggtgattccaacttatgctcttcaccatgacccaaagtactggacagagcctgaggagttyccgccctgaaaggtacaagtctccagggaaatggagctcaccctgacccaggctggttcaagcatattctgcctctcttaatctacatgacaatcgtgtggttgtgcaatcatttgcttgtaagtctttttatcacaaaaaagtgataattatcaaactttacaaaccacagactagaaaaaacgaaactacatccatccacagtccccgc

SEQ ID NO: 35697 - DNA, 322 bp, Homo sapiens
  misc_feature 128: w=a or t
  misc_feature 131: w=a or t
gaactgatgctgtttgtttgcttctatgatacagagatgtctaaaaacttcaaatggacatgttttgtagtttagcgacttccgtatacataaagggacatattaatactggttcatttgtaaattawtawttcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgcc

SEQ ID NO: 35698 - DNA, 233 bp, Homo sapiens
  misc_feature 112: r=a or g
  misc_feature 131: m=a or c
tggacttccggcggtgggactgtcacttcgccgcccgcgtcaggccacaccggtggtctgggctggggaccgcgggtcgggtccggtttccagggggttcctggtgctcgargctggcggcgaggaaggamcagatggcctttgaggaatgtggctgtgtacttctcccaggaggagtgggggctcctggacacagcccagagggccctgtaccgccgcgtgatgctagatga

SEQ ID NO: 35699 - DNA, 311 bp, Homo sapiens
ctcaaatgacccaatttaaaaatgggcaaaagatttgaatggatactttatcaaggaagatataagatatacagatggcaaaaaacacatgaaaatatgctcaatatcagtagtcatcagtgaaattgtgtacctgttagagtgactaaaaaaaatgatgataccaagacatggtgaagatgacaagggactggatatcttacacgcactgttggtaggaatgtaaaatggtacagccacgttggaaaacagttggcagtgtcttataaagttaaacatacatttaatatacgactcagtaatcgcaaccc

SEQ ID NO: 35700 - DNA, 229 bp, Homo sapiens
atttcgttcttccaagaacctactctattttaacagatgttttaggtcctaacttgtgtcctaattagatagagagggtctgttaggttcttgggatcttgttcttcaactgcacacataccagcacaactactgttaaatttcttttgcgcttttttcccctttaggacaaaaaaaggatttaacagttatgtgcttttaataacattgtattactttgttggtaacc

SEQ ID NO: 35701 - DNA, 325 bp, Homo sapiens
cataacaaaggcatgttgaatttggtctcattcattagagtataggacttttgtttggtcacatctttatcatttaagaaacatttaaaaatggtattcatttttatttcaacatgtcaactgtgcatttccaaaacagcaggcttttcaaaggaataaatcagaactgtaaacacaagacacagtacaagtttttgacttcctacagtcagtttcacaaatccacatactgtacattcataggtgaggttaagcctgtcacccatttctttatttctataattacacaagcataataaatacatctgattttaaaggtcacaaa

SEQ ID NO: 35702 - DNA, 175 bp, Homo sapiens
tttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgttttt

SEQ ID NO: 35703 - DNA, 203 bp, Homo sapiens
gtggtgctttgatacctcttaaagcattttttggagtttgcccttcaccttggaaagctgggtgggggattctgtcctccatgaataacggcgccaggaaccttgggcgatcttgagaaaactccttcctgtaacctctgttttccacgttggatgtgttttaggccacagtcaggcctggcttttttttttttttttttttt

SEQ ID NO: 35704 - DNA, 118 bp, Homo sapiens
attttatttgcttggaacatttttggcttctctgtccacaccatagaaaaggacaaaggccttccagctctccttttctcttatttgttcccttctaaatacttgactccctggggga

SEQ ID NO: 35705 - DNA, 419 bp, Homo sapiens
  misc_feature 115: y=c or t
  misc_feature 117: y=c or t
  misc_feature 369: m=a or c
tctccaaagaaccaaaaggatcaatatttctggattcctgtatgggtgtcgttcagaacaacaaagtcaggcgttttgcttttgagctcaagatgcaggacaaaagtagttatcycytggcagcagacagtgaagtggaaatggaaaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgmccagaagcttgacttctcatcagctgagcagaagtgaagtcatttgaaga

SEQ ID NO: 35706 - DNA, 158 bp, Homo sapiens
gaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgggg

SEQ ID NO: 35707 - DNA, 110 bp, Homo sapiens
acatattgctgtggtggtgaaaagtcacataacttccatgaagaagtatttatcaatgtctattaaaatgtaaaatgcacgtattctttgactcaacagttccacttcca

SEQ ID NO: 35708 - DNA, 202 bp, Homo sapiens
gttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaat

SEQ ID NO: 35709 - DNA, 126 bp, Homo sapiens
  misc_feature 11: k=g or t
  misc_feature 72: y=c or t
atatgcctaakagtcagggggagtgagtgggttcatattcctactgcaccacctccttgctggctgttcaayaatatgtcttataacatgtcactaatgtatctaatcagtggacctggtgtggat

SEQ ID NO: 35710 - DNA, 284 bp, Homo sapiens
gtttgttttggttgggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggccc

SEQ ID NO: 35711 - DNA, 478 bp, Homo sapiens
  misc_feature 28: n=a, g, c or t
  misc_feature 29: n=a, g, c or t
  misc_feature 147: d=a or g or t
tgttttatggtgcatatagcaataaagnnccccctccaccctgcaacccccatcccccaccgggcctttgtccctgccttggcttttctccccttctcattctcctctcccctttcctcactgaaggctgtgagttgctttcaatgdgacaacactatgatgtcatttggaaggatttgccaggacagactgattctgagtcctgggtgccgtatgtgtatgcggcagtgttgtcaggcaatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtcaccaggcctcgaatatcatatgggaaagc

SEQ ID NO: 35712 - DNA, 141 bp, Homo sapiens
atttagagagagagcctgggcaacatggcaaaactctgtctctataaaaaatgcaaaaaaattagctgggcatagtggcatgcatctgtagtcccagttatttgggaggctgaggtgggaggattgattgagcctgggggt

SEQ ID NO: 35713 - DNA, 270 bp, Homo sapiens
ttaaaatgattctaagttcaatcaggcaagaataacaagaaaaaaaaattcgggccaggtgcggtacacacgcctgtaatcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaactagc

SEQ ID NO: 35714 - DNA, 122 bp, Homo sapiens
aatacaaataaaaacctttttgtggttgtaagatttagcttataaatcattcaaattgaagtgaaagaattaccaggtcattgttaatgacttagtctattaagaatatatgtatttttgta

SEQ ID NO: 35715 - DNA, 177 bp, Homo sapiens
aaaattagataaaacctaagttgcaattctgtttttcctcaaaatctaagacatgtcacaaaataatttactgcctttgtttctctctctggtaacatcttcccaccacatgtatttcccgccttagagattaaaaggcaatcacccaaaaccaacagtggctaccctctccggaca

SEQ ID NO: 35716 - DNA, 343 bp, Homo sapiens
  misc_feature 273: n=a, g, c or t
  misc_feature 274: n=a, g, c or t
cctagagtatacattagaatctcattaaaatcaggcttaacattggtctgtcttgcactatacaaagtgtatgaaatggaaatcaaaatacctttttattgcactactctgtcctgaagcatggacttcggtgtataacattgcagcaaggctctagaaatttcttaatagggtctggctagtttagggcttcgagtgcattgaaattgaattgtatgtgttgtcaaaaacttacagtttagtcaattttttgctaattcctttgatgaatcnntaatctttttgggtttgtaattttctaatgtgtgaaataaggtatttttagacttctaaagcgcccccc

SEQ ID NO: 35717 - DNA, 157 bp, Homo sapiens
caaaaattagttgggtgtggtggcatgcgcctgtaatcccatctactagggaggctgaggcaggagaattgtttgaacccgggaggcggaggttgcagtgagccgagatggtgccattgcactccagcctgggcaacaagagcaaaactccatctca

SEQ ID NO: 35718 - DNA, 194 bp, Homo sapiens
  misc_feature 16: r=a or g
  misc_feature 131: r=a or g
  misc_feature 139: m=a or c
ttttcaattgtggtaraatacagtttatcaacttggccatttttaagtgtacagttcagtggtatgaagtgcattcacattgttatgcagccattaccaccatccatctttagaactcttttaatcttgcraaaatgamactgtgtgtgtatattaaacaatcacgccccattacttccttcccctggcacccc

SEQ ID NO: 35719 - DNA, 295 bp, Homo sapiens
  misc_feature 5: k=g or t
  misc_feature 30: k=g or t
  misc_feature 31: r=a or g
  misc_feature 33: r=a or g
  misc_feature 70: n=a, g, c or t
  misc_feature 72: s=g or c
  misc_feature 201: s=g or c
  misc_feature 281: s=g or c
acctkttctctttgcctttcatactgcttkrgrcccctcactgcttcctaacataactttcactggcaanasacggagtcctgggtttcagttccagttgcctgcggtgggctgtgtgagtttgccaaagtcccctgccctctctgggtctcggttccctcgcctgtccacgtgaggttggaggagctgaacgccgacgtsatttttagctaagagggagcagggtccccgagtcgccggcccagggtctgcgcatccgaggccgcgcgccctttcccctsccccacggctccca

SEQ ID NO: 35720 - DNA, 64 bp, Homo sapiens
  misc_feature 2: b=c or g or t
  misc_feature 3: r=a or g
  misc_feature 16: n=a, g, c or t
  misc_feature 25: r=a or g
  misc_feature 40: r=a or g
  misc_feature 59: s=g or c
abrgcggagaggcctncggcgaggrtggagggcctggcartgcggttgctgcgcggcascaagc

SEQ ID NO: 35721 - DNA, 136 bp, Homo sapiens
  misc_feature 132: s=g or c
ttttgaaaaggcttattttatacatacgtattatatagagaaacaaatgtttttattaaatgtttcattgacccaagtaatttaaaagtaatatgttacctatgtctttcaggaaaaataattataggcagscata

SEQ ID NO: 35722 - DNA, 105 bp, Homo sapiens
acaaactttccgtcccgctcgctccctcctccgcgctcggcgcctcccgctccagcccggctcattccgcacattccggccagccccctccccacaaccccccca

SEQ ID NO: 35723 - DNA, 318 bp, Homo sapiens
tacatggttgaagtgatggatatcctaattattctgatttgagcattgtatagatatatggaactaacactctgtacctcataaatatgtacaattaagtgtcaaaaataaaattaaaaaaaattttattatattcttaaaaaaaagaataagtagtctctatgaatttgaagggggctcctgtgaataaagtgactagaaaacttgacatcaaatgtggatactcagaagacttttttgggctaattctttgctgtttcccaaatggtcaagattgacagaaactgttctctaaataaattatgcatacagtagctc

SEQ ID NO: 35724 - DNA, 267 bp, Homo sapiens
  misc_feature 158: s=g or c
agccttgctgccgccttgcagtttgatctcagactgctgtgctagcaatcagcgagattccgttggcgtaggaccctccaagccaggtgtgggatatagtctcgtggtgcgccctttttttaagccggtctgaaaagcgcaatattcgggtgggagtsacccgattttccagaattatagaccaatccagcaatgtggagatagcatcttttccaatctataaggtgttattctgtgcacgtggacatgacggaacaacagagcagc

SEQ ID NO: 35725 - DNA, 446 bp, Homo sapiens
  misc_feature 365: n=a, g, c or t
aaagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtatgcggcaaggaatgggcacccagagatagtccaatttctgcttgagaaagggtaaacattttaggctgtaccacctgaaagggtttgtggtttaatttctttgttacatatttacnttaaaattttgcttgtttccatatttatattgttgaactactaaataactcattggctaatttatgtaaaaatgtagcacc

SEQ ID NO: 35726 - DNA, 363 bp, Homo sapiens
  misc_feature 71: h=a or c or t
  misc_feature 72: n=a, g, c or t
  misc_feature 126: m=a or c
  misc_feature 129: h=a or c or t
  misc_feature 308: n=a, g, c or t
  misc_feature 309: n=a, g, c or t
  misc_feature 351: r=a or g
gttagagaattttatcaagttagagtatttgcttttcaacgtccaggctgtgagaactagaggtgtcatthnttcaagggagcagatgttaaaggttcttgcccctgcctccctaatcccaaatamcchttgaagaagagaaacgttctgttacccaaataggcatctttctgatggtgagaaaaggcggtaaaaggcagtaaatctgccttctcattatgaagtgcaacaatagattgatttatgaagaaaagcaactgttaggcttatataagatgtgtgcatggaaatgcaggttcctttagaannttataagcagcagcattcctcctattctggacagaaatctartattactaatca

SEQ ID NO: 35727 - DNA, 105 bp, Homo sapiens
tcataggtttcaagtctcctgcctagtttcacttgttctgtaattgggatatagagggatagggatgtgaggtatcactattgttaggttgtgaatggagagcta

SEQ ID NO: 35728 - DNA, 225 bp, Homo sapiens
  misc_feature 121: k=g or t
ccacacacttgcaagaactcactgtcaggaagacagcaccaagctgtgagggatccgctcccatgacccagacacctcccaccaggccccacctccagcactggggagtacaattcatcakaacatttgggcagggacaaatatccaaactttatcagtgtgttagagagaagtcaggccctgttctcttctctggggtgtatgttttgtgatgatggcgatggg

SEQ ID NO: 35729 - DNA, 214 bp, Homo sapiens
tagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagat

SEQ ID NO: 35730 - DNA, 233 bp, Homo sapiens
caaagtaaatgcaaagcaatttagtcttttcttcttcatgcctttaggattattgcgatggatgtcagttattatctcaaatgccatcgagagatgctcagggctgcttgaattggttccagagcttggtgcttcagagtagagtatacagtcactttttatatttttctgtctctctcctcactgtctactatattttatttctattccttttcctattcttcagccacacc

SEQ ID NO: 35731 - DNA, 91 bp, Homo sapiens
ctttccgctccaacgcacggagggtgaggtcggtacgcggtggtggcgtcacggcgccagctcctcccgacgccgagattgggtaactcaa

SEQ ID NO: 35732 - DNA, 291 bp, Homo sapiens
  misc_feature 127: k=g or t
  misc_feature 130: k=g or t
ttgtatggatagtaaaattctactgtatggaatacaatgtaattttgaatccatgctggctctgatggctcttattagtctgtatttataaaggcacacagtcctattgtagcttatctttcgttakttkactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggct

SEQ ID NO: 35733 - DNA, 270 bp, Homo sapiens
  misc_feature 112: r=a or g
  misc_feature 184: k=g or t
ctaaattctacagaaggtgaagcccggggaaatggtacacagcctgttctctctggaacgggagaagaaactgttaggctaggatttcctgtggatccacgaaaggtgctartagtagctggccatcacaactggattgtagctgcatatgcccattttgctgtgtgttacagaatcaaagaakcttcaggatggcagcaagtgtttacgagcccatatttggattggactatcgaacgagtagctttaaatgcaaaggtggttggaggg

SEQ ID NO: 35734 - DNA, 385 bp, Homo sapiens
aaattcaaatcaaaaccacaattacatgttacctcatacatgcaaggatgggtactatcaagagagattagtgttagagtacagagaaaaaggaagctttgtatactgttggtgggaatgtacattggtacagccattgtgaaaaacaatatggaggttctgcaaaaaaaaacaaaaactaccatgtgatccaacagtctcactcctgggtatatgcatatatgaccaaaggcagtgatcagtatttcaaagagatatctgccactcgcatatgttcattacagcattattcacaatagtcaacatatggaaacaaacttagcatccattaatggatgaataaagaaagtgtgatgtatatttaaacagaatattactcagctct

SEQ ID NO: 35735 - DNA, 169 bp, Homo sapiens
taccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccc

SEQ ID NO: 35736 - DNA, 220 bp, Homo sapiens
atcccatcagctgccagtgaggccagaacaaagcaagcagaagagaaaagggtgagcagcttgctcatcactctctctgtcttcccgtgctggatgcttccttcctctcctcctgcccttggacatcagacttcctggtctttggcctttggactctgggacttgcaccagcggcctcctggaggattacagggcttcatcctaagaccgagacctacgc

SEQ ID NO: 35737 - DNA, 231 bp, Homo sapiens
gtcgggaggtggactcgaggctgcagtcctcgcccggttttaacaacctggatcttcgaacttttgacacggctttggaaacgacgtcatgtgttagaattggagcgttattcagtatattaatgtcttattgataatggcagaacatccaccactactggatacaactcagatcttaagtagtgatatttctcttttgtctgcccctattgtaagtgcagatggaaccac

SEQ ID NO: 35738 - DNA, 120 bp, Homo sapiens
agcaagccgggacggtggcagcaagggagaaaggacgggatggaggagggggcttcgcggtaaccacaccccttcctaatgagttaatttccatatttgcgcctcccgcatccagcgccc

SEQ ID NO: 35739 - DNA, 109 bp, Homo sapiens
ataaaagcaagcattgctattgacaatggaagagcagctgagttcatccgaagcgaaactactttgataaatctaagtgttatgaatgtggggaaagtgggacacttaa

SEQ ID NO: 35740 - DNA, 368 bp, Homo sapiens
  misc_feature 116: y=c or t
acaatgctaaaggtcttgactgcttggtgaaaaccactttgcaacactggtgttggaaattactttcttatattaagctgaaatctacctcattggaacctctgctcataagtccytgagtctcatgtagttcagaccttgtctcttctgccccatctggctacttatctccagtttctcctgccagtcttccggtggcatagccccaaaccctttcatttcatagtttgtcactgccctttttaagaggactggggtgctcagaacttattggctgaccctagctcttcctttggcctggtcactatatttgaaaagtgctacctgaaatcataagagcttttttgttttgtttttaacagccatgt

SEQ ID NO: 35741 - DNA, 420 bp, Homo sapiens
attacagctctacaatgcaccagacggacccatctggattctttcggggctcttagccctagaaatagcatcatttcttcaaactggtgagtcctcctgtctaaaatcaggatgcagagagttgatgcacggcatggcacaggatgctgggcaaggctggcaggcccgggagagcctgtggccagcctgggtccaggaagtgggcagctgccacagaggggcctccgaggctagctgcctcctaacttcctcacggcacaccattctgccgtcctgagtcttctcaaggttggaaggtgcccagatccagggagatggtgctggctctttggtggctgtggagtgtccagacagatgagctggaatccttcagtttctctgcctctcctgtcaagttggggtagcactgcttggactctt

SEQ ID NO: 35742 - DNA, 224 bp, Homo sapiens
atattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggc

SEQ ID NO: 35743 - DNA, 471 bp, Homo sapiens
catttctgtattttagtaaacatacatatacagaaaagtgcacaaataagtggacggcttagagaatttttataaacccagaggccctcttagtctcctttaagtcattatcatcgatgccctgatgcttgcgtagtgagtcttctgatttctagaactgtagactaattttgcctgatttggattttgtgtaaatggaatcatacactgtgtattcttgcatatctggtttctttgactcagtgttgtttgtgagactttgtgttgttgtgtacagttgtaactggagtttccattgcttagtagtattatgtgatatatcataatgtatttaagtaaaaagactgagttttagggtatgtgtctgtattcatttgctagggctgccgtaacaagtatcacagatagagtggcttaaacagaaatttattttctcaattctgaaggttagaaatctgaggtcaagctgtc

SEQ ID NO: 35744 - DNA, 260 bp, Homo sapiens
catgtaattgtatcctaaattcctttgtactttttattttcttccttggtcttcaattatcttaagactaccaagaaaacaaaaattttaaaaatcttcttcagccggtcaggcgcagtggctcacggctgtaatcccagcacttggggaggctgaggcgggtggatcacgaggtcaggagttcaacaccagcctggccaacatggtgaaacgtcgtctctactaaaaatacaaaaattagctgggcattgtggcgcgct

SEQ ID NO: 35745 - DNA, 132 bp, Homo sapiens
agaggtcgcgttccccagtgttacggagggtccttgaggcaggagtgaaaattgggtctgggggttagtcctggggtggaggtctgggcacgccgggtcggaccccctccatcttcggttttgcacacccca

SEQ ID NO: 35746 - DNA, 278 bp, Homo sapiens
  misc_feature 240: n=a, g, c or t
tcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatngcaatttgatcttccttttttagaaaaaaaaaaaaaaa

SEQ ID NO: 35747 - DNA, 217 bp, Homo sapiens
  misc_feature 145: v=a or c or g
ccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcvagattgaaagtagctgcacatgaagctgaggaagaatctgataatattgcagaagacttcttggagggttgc

SEQ ID NO: 35748 - DNA, 212 bp, Homo sapiens
caccaaaaaatgttattattattattattattatttttaacggagtcttacttcgtcacccagactggagtgtaatggcgtcatctcggctcactgcaacctccacctcttgggctcaagcagttctcctgcctcagcctcctgagtagctgggattacaggcgcccaccaccatgcctggctaatttttgtatttttaatagagacggagt

SEQ ID NO: 35749 - DNA, 466 bp, Homo sapiens
tttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaat

SEQ ID NO: 35750 - DNA, 154 bp, Homo sapiens
acaccaggagcctcctcgtggagggggggagcggaggaaaggggtagctccgccacctctgctggcggcggcggcggcggcgaaagaagaagaaagtcagggcccgtacctaccgccacagactcagaaacgcccctgcccccatctccccaaa

SEQ ID NO: 35751 - DNA, 123 bp, Homo sapiens
  misc_feature 59: s=g or c
atgttgtaaggtgaattgtaactatgcattctgcaaagggggtggggaggagagggcasaaaggggaagggagtagcgttgcatccttgttcttcagtttctgtgtccatggtgtccccgtat

SEQ ID NO: 35752 - DNA, 460 bp, Homo sapiens
  misc_feature 327: n=a, g, c or t
  misc_feature 328: n=a, g, c or t
tgaaactgacttttggagctttccttcttttttcatttcaactgaaaatgctttaggtaaaaacctttccagtatgttcacctctagaatagccacccaaagaccttcctgaggctgcctcagaagccacccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccgnnaggggctctctggcttcctgaaagcttcacctcttccctcgtttatatctcaactgtaagggcattttcaagcttctgttcatggaatgagcaactcagactgtctggagcttgctgagtacaaacacacca

SEQ ID NO: 35753 - DNA, 402 bp, Homo sapiens
  misc_feature 118: r=a or g
  misc_feature 123: k=g or t
  misc_feature 126: y=c or t
  misc_feature 127: y=c or t
  misc_feature 128: r=a or g
  misc_feature 134: r=a or g
  misc_feature 285: r=a or g
  misc_feature 375: n=a, g, c or t
  misc_feature 376: n=a, g, c or t
  misc_feature 377: s=g or c
ctgaatcccctggaaatggtcctgcagagggctctgttggaaccttgatagaaatgagctcttcaactcataaatcctatacaagttaccatttatgatggagagtgcagaagatagrtaggktcyyragcagrgcataatgggaaatatcagaaatgtctcatgggagatgctttctggttaaactagagatgattttctccccatccacagcgaggtcctgccagattagtgtaatttggtaatccctcattcaggattaccaaattataatttccctaactrgatcacctgaaactccagtgttaccttacttggttacaaaaactgcctttcaccagtcaggccacctggatctgacattcaggtgccagnnsagttttcttccataccaccagggct

SEQ ID NO: 35754 - DNA, 106 bp, Homo sapiens
tacgccactttggctggcatccaatggaggtcattttgatgttgtgcagttgctagtgcaagcaggtgctgatgtggatgcagcagataaccggaaaatcacacct

SEQ ID NO: 35755 - DNA, 369 bp, Homo sapiens
  misc_feature 125: r=a or g
  misc_feature 127: k=g or t
  misc_feature 130: r=a or g
  misc_feature 133: k=g or t
  misc_feature 136: w=a or t
  misc_feature 149: r=a or g
catcatggtgctggcacctagcatttgtgcatttggtccttagagacctaattagaagagaatttactttgtttttaaaaatgcatcaaatcaccaatggataaactatggtgtctgcattaccrgktgraakgtwacacagcaataaraataaaaataaacagtatagctacctacaacctcaatgagtggtaagggctaataggtttacgcacatgtaattttttaaaagcgcttttctgtgttgtatttcccaataatagtacctgcaaggttaaggttgtttttccttgtgttctcttctctcctcctctccccactctcttccgctttccctgcctccccccacctcagtcattcactcacggc

SEQ ID NO: 35756 - DNA, 294 bp, Homo sapiens
aaaacttggctcaggctgatcaccatgctagtcacaggagggagagagaggcagtgtacttgctcccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccct

SEQ ID NO: 35757 - DNA, 313 bp, Homo sapiens
  misc_feature 123: r=a or g
  misc_feature 128: k=g or t
  misc_feature 130: k=g or t
  misc_feature 145: m=a or c
  misc_feature 177: r=a or g
  misc_feature 182: k=g or t
  misc_feature 183: r=a or g
  misc_feature 185: s=g or c
  misc_feature 191: r=a or g
  misc_feature 194: w=a or t
  misc_feature 206: s=g or c
  misc_feature 207: k=g or t
  misc_feature 208: y=c or t
  misc_feature 214: w=a or t
  misc_feature 223: r=a or g
  misc_feature 260: k=g or t
ttttaagggtctggctattccttatctggaacacatcatccatgtttgggaggagacaggctctcggttccacaactgcctgatccagctatactgtgagaaggtgcaaggtctgatgaaggrgttakckccggtccttccctgmaggcaaaaccccagtcccagctggagaggaaragggkrasctgggrgawtaccggcaaaaskyccccawgttcttggrgatttccagctactatgatccaggccggctcatctgkgattttccctttgatggcctcttagaagaacgagctctcctgttggggcgcat

SEQ ID NO: 35758 - DNA, 96 bp, Homo sapiens
taaacgcacttttccttcctgcacagctaacttctacatcactgaaatgcccattccttcctccgtcccacctccagccgaatagaaggtctgctc

SEQ ID NO: 35759 - DNA, 261 bp, Homo sapiens
tttttctttgttgcagtggctctgaccaatctggaagatatagaaaatgccaagagagcctacgcagaagcagtccacctggataagtgtaaccctttagtaaacctgaactatgctgtgctgctgtacaaaccagggcgagaagaagaacgccctggcccaatatcaggagatggagaagaaagtcagcctactcaaggacaatagctctctggaatttgactctgagatggtggagatggctcagaagttgggagctgc

SEQ ID NO: 35760 - DNA, 222 bp, Homo sapiens
tgaaaccacacaaagacaagcggagaaaaagctgatataaatatttataacattcattttataactttgttttaaatatgagttaatatacaattctttgataatctgccttttcccagctcttcatggtttgctccctggtatcattcaggtctctgctcagatgtccctgacaccaagaggccactgtcagccttgtacaggaacacacacccccaacac

SEQ ID NO: 35761 - DNA, 337 bp, Homo sapiens
  misc_feature 296: y=c or t
ttgagtccctgcccctccccaccactcagctctgctttccagaggttctccagctttctaatatctgtagaggggaacaacttctccccagcatctccttttcagaccctaagctatgggcttctgtgtgtggtctgctaagccatttgcccttccgccactttcagtctttgtggattgtgatttgggctaatagaggtcctttagtgatatcaaagatgtactggatttttgtttcatggtttccatgatttaagtgtgatttctcagagatgaacaggcagagagatccttgyatgttgtctcaggatctatgtttttaaccactgacgctata

SEQ ID NO: 35762 - DNA, 181 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctc

SEQ ID NO: 35763 - DNA, 258 bp, Homo sapiens
  misc_feature 133: s=g or c
ccaaagaaaaacatggtgaaaccccatctctactaaaaatacaaaaaattagccgggcgtggtggcaggcccctgtagccccagctactcgggaggctgaggcaggagaatggcatgaatctgggaggcggasttgcagtgagtggagatcgcgccactgcactccagcctgggcgacagtgagactccgactcaaaaaaaagactatcatgattctgcctgccatggatcagctatcccttttgaaatgaagacaac

SEQ ID NO: 35764 - DNA, 200 bp, Homo sapiens
ttcagtattgctgctttacatctccagaataagctttcgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatataggggggc

SEQ ID NO: 35765 - DNA, 159 bp, Homo sapiens
cttcttattgccccaccctttgccacactccttcagagatgcgcagtgctgcccctttctatgggcagggccgaaggtccgcgtgtaaaagtacccagtcactggtaacctgacacttcccttttaaaagccaccttttgtctatctctggcccgccac

SEQ ID NO: 35766 - DNA, 228 bp, Homo sapiens
caaggcggtagactacagaataaaaacaaaggatatagaaagattgttttccatatttaaatacagcagtactgagttttctgatatactgtaaataacctaaatgctaaaggattcatatagatactttgtaattgctactttctctaatggattgtatgtatatatgatttgaggtataccctgaaagaagcataagactcagttgactgaaaaaagggggcgccg

SEQ ID NO: 35767 - DNA, 289 bp, Homo sapiens
  misc_feature 16: k=g or t
  misc_feature 17: y=c or t
  misc_feature 19: s=g or c
  misc_feature 71: r=a or g
  misc_feature 128: s=g or c
  misc_feature 131: w=a or t
  misc_feature 134: r=a or g
  misc_feature 152: r=a or g
  misc_feature 176: s=g or c
tctgaggcatggagakyasattcagggtgtgtgtgtgtgtgtgtgtgtgtgtgtgtatgtgcgtgtgcgtrcacatgtgtgcctgcgtgttggtataggactttaaagctccttttggcatagggaastcwcgraggattgcttgacatcargagacttgggggggattgtagcasacgtctgggcttttccccacccagagaatagcccccttcgatacacatcagctggattttcaaaagcttcaaagtcttggtctgtgagtcactcttcagtttgggagctgggt

SEQ ID NO: 35768 - DNA, 230 bp, Homo sapiens
  misc_feature 35: s=g or c
ttgaaacccagcatttggagctgagtcagctttgsagcagacaagaatgctaatgcttaagaggtagggagcaacaagatggaaggaacctgggtccctggatatacttatagaacacagctgtctccatgcccttgacagaaataaaatatcttgtttgagttattaaatttggggtcagtttaggctatacacagcacgtttgcctgtagcctaactaatatggtggc

SEQ ID NO: 35769 - DNA, 126 bp, Homo sapiens
caattttcataacttggataaattatagttttgtttgttagaaaagttgctcttaaaagatgtaaatagatgacaaacgatgtaaataattttgtaagaggcttcaaaatgtttatacgtggaaac

SEQ ID NO: 35770 - DNA, 218 bp, Homo sapiens
  misc_feature 124: s=g or c
  misc_feature 133: m=a or c
  misc_feature 198: s=g or c
  misc_feature 199: n=a, g, c or t
aaaacttagatgggcatggtggtgtgtgcctatagtcccactacttgtggggctaaggcaggaggatcacttgagccccggaggtcgaggctacagtgagccaagagtgccactgcactccagsctggggtamcagagggagactcctccgtctcaaaaaaataaataaataaacttgtgagctggccccaacccctsntaggaatcacagctccccc

SEQ ID NO: 35771 - DNA, 339 bp, Homo sapiens
  misc_feature 123: m=a or c
  misc_feature 191: s=g or c
cctgagaatgacagttggaaagagatgtggctgcaagattattggcaaggtctggaccagggggaagctctcactgccatgatccacaacaatgaaacagagcagacgaaattttgggattamctacatgaaatcttcatgaagaggcaacatctctaagtgcccttgcaagagcctttaacttggcggastaaggagatcttattctaccatgggacataaggagcatccactgcacaaacccttaatgaacactgtcttttcatggattcaaggaattccagttttatctattaagattttatcttaatgatgagtagccaaggtctaacatagggc

SEQ ID NO: 35772 - DNA, 205 bp, Homo sapiens
  misc_feature 115: r=a or g
  misc_feature 124: m=a or c
  misc_feature 126: y=c or t
  misc_feature 127: w=a or t
  misc_feature 129: r=a or g
ctacatgctcacaagacctcctccaactttcaaataaattcttagttatggaccctaggttaagaatttagaagacatcctaaatattgaaattttattgtatagataagtaggragttaaaamcywargaaaatcatcaaatattaggggtgcttctgaattgatttatctgcagtttaactacttagcatttatggaagggcg

SEQ ID NO: 35773 - DNA, 155 bp, Homo sapiens
agaatatcccttctgctctggtagagtaaagctgagtgtagggctgatgttacggaggatgtagtcctcctatgtcttcctggatttttctccctggatcccagagaaatagcattcaagcccagcttgctcactcccatttgcatctggaacca

SEQ ID NO: 35774 - DNA, 124 bp, Homo sapiens
ttttgtttctttgcctcctgcagtctgtgccttccaccatgatcatgaggcttccccagccacacagaactagaaggagtcttgccatattacccaggctggtcttgaacttccgggctcaagt

SEQ ID NO: 35775 - DNA, 178 bp, Homo sapiens
  misc_feature 135: y=c or t
  misc_feature 137: k=g or t
catcttaaatggtgaatcctttccagaaggtttccagtttactttgcccaaatccatcagaggaatcactgtgacagctatagccttgcaaaaaatattcttgcataataagacttgaaagtcaaaactattccytkgatcccatggggctaatggaatggatgtgtagcaggcatcc

SEQ ID NO: 35776 - DNA, 57 bp, Homo sapiens
agatcgatctaagatggcgactgtcgaaccggaaaccacccctactcctaatccccc

SEQ ID NO: 35777 - DNA, 168 bp, Homo sapiens
  misc_feature 136: b=c or g or t
  misc_feature 148: w=a or t
aatgaaagcatctcacattggttttctttcttgtatcttttctgaaactccttgctgtaaggcagctttctcagagtactatatattttcaacagtaaagtagcagagtttctctttgaaacccaaaatgtcctcbtaaagaatcaawtttctatttctgcctctgcg

SEQ ID NO: 35778 - DNA, 189 bp, Homo sapiens
  misc_feature 136: y=c or t
  misc_feature 138: m=a or c
ccatttaataggcccctttcttctgagtattaggtgagttgatttgtggagaagccccttcccccctgaacacacttgcacccacccatacctgtttcactttatagctggggccttctctgcacttggggccttycmatcccgatcatagggcagaaaggccattccctgaggaagatcctggacggt

SEQ ID NO: 35779 - DNA, 291 bp, Homo sapiens
attctagagggagctcttccccacacttacttctaagaagtaataattttaagtttcataatcaaggagatgttgattttcttcctggttttctggtgctccttatcttttctggatcactaacttaaattaagaatccacttatgaatgctgcattcaggagcacttgtgaaaataaacgatggcatgcccaccatttagtttgccaagctttccttgaaaacgcaggtgcaaactgaacaatgaggacgcatggacacaggaaggggaacatcacacaccagggcccgc

SEQ ID NO: 35780 - DNA, 119 bp, Homo sapiens
  misc_feature 19: s=g or c
  misc_feature 88: h=a or c or t
tggtcgtggtctggcggastgcggttggcttgtggcgtctccgccgccgccgccctcccttcctcttccccatcttcttctctcggthccgggagcccccgcccggagagagtcgcggt

SEQ ID NO: 35781 - DNA, 231 bp, Homo sapiens
  misc_feature 23: y=c or t
  misc_feature 131: w=a or t
  misc_feature 137: w=a or t
tacagtataatatgttttcaggyaaaaagtctgtcagaatggtctttagctgcttcattgcccacaggttaattggtataaaaacttccttgacaccacttttaaatatatttacatacacacgtgtgtawgtgtawgtgtgtgtgtatgtgggtatatttgtgtatatacatgtttgtacatacattatgtgtgtgtgtatatacgctttgtcttatctgtaatggccga

SEQ ID NO: 35782 - DNA, 280 bp, Homo sapiens
  misc_feature 138: s=g or c
atatctgaagttcgtaaattgaaattgaacatgcgtaattaatctttctgaataggaaaaaatatatacacaacaaaactctccgtttatggaacatgcgcatttgttctcagtaagtttttcgttttgaaagtgagsatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggctt

SEQ ID NO: 35783 - DNA, 280 bp, Homo sapiens
  misc_feature 86: k=g or t
  misc_feature 118: y=c or t
  misc_feature 119: s=g or c
  misc_feature 125: y=c or t
  misc_feature 129: w=a or t
  misc_feature 152: s=g or c
  misc_feature 157: w=a or t
  misc_feature 173: y=c or t
  misc_feature 209: r=a or g
  misc_feature 234: w=a or t
  misc_feature 241: y=c or t
  misc_feature 242: y=c or t
  misc_feature 261: w=a or t
  misc_feature 275: w=a or t
tcaagtagggaagaacaaaaaaatcaagtaacctgtttccaaggtttgacaacttatttgcaaaggacaaggataagtttttcgtkatcttaggaaatataaagcatcatagtatttystcagcycttwagtggaaatgaccttacccaatscattwatcctcttcatacttycaatataaaatgttatgagtaaaggggaaaagccargattttttagggtgaacaagtggawtggagtyyttgttttttaaaatgttgwctgctatgcttttwaaagc

SEQ ID NO: 35784 - DNA, 60 bp, Homo sapiens
  misc_feature 17: d=a or g or t
  misc_feature 52: k=g or t
  misc_feature 56: k=g or t
gggcgccggtgcgtgtdgccttcaggtgaccacggattcgccatcgtgagtkccakgatt

SEQ ID NO: 35785 - DNA, 366 bp, Homo sapiens
  misc_feature 60: w=a or t
  misc_feature 173: w=a or t
  misc_feature 267: w=a or t
  misc_feature 268: w=a or t
ccagtacatacattttaacattaagttcagtacacttaatgaagaatcacagaatttgtwttttcttgcactgaacacctacagtgtgtagcacctgataaatgcttcatcccccccaagagtagagccactgtgtaaggctgcacttgttatgtactgcagaagccaggggwgccatcagtagacctcattgtgagcaggcccgtgtcccaaattgcatgggagccccttgtccactaattaaagattgacaagtgaaaggcagcwwgcttacccgatgtagcacttggcagctctcagaggcagccttggtggtttcactgcttcatagttcagtgcccccagggtgagtgcagcatcagggat

SEQ ID NO: 35786 - DNA, 138 bp, Homo sapiens
  misc_feature 84: k=g or t
  misc_feature 88: s=g or c
  misc_feature 91: k=g or t
  misc_feature 92: k=g or t
  misc_feature 98: y=c or t
  misc_feature 99: y=c or t
  misc_feature 104: k=g or t
  misc_feature 105: k=g or t
ctcttgagagtggacatcatctcctggggctgcacgatcacagccctagaggtcaaagacaggcaggggagagcctcggacgtkgtgsttkkcttcgyygagtkkgaaggatacctccaaaagcagccatactttgga

SEQ ID NO: 35787 - DNA, 120 bp, Homo sapiens
tttaatttcagagaatttgcttcaacttactggaattaattaaaaatgcttttgtatttatattttttcttttacatatttaaagtattaagataaagtcattgtctaatgttgtctgcc

SEQ ID NO: 35788 - DNA, 215 bp, Homo sapiens
taagagatgtgaaaaagacacagatccattttgatccagaagtagttcagataaaggctggaaaagcagaaattgacagacgaatatctgcatttattgaaagaaagcaagctgaaatcaatgaaaacaacgtcagggaattttgcaatgttattgattgtaatcaagaaaatagttgtgcaagaactgatgcgatttttaccccttaccccggc

SEQ ID NO: 35789 - DNA, 59 bp, Homo sapiens
gcctggctcgacgctggagtggggagaagcatcatggttcaacgttcatctgcagaagc

SEQ ID NO: 35790 - DNA, 199 bp, Homo sapiens
  misc_feature 106: m=a or c
  misc_feature 111: h=a or c or t
  misc_feature 137: m=a or c
gacctgaaggctgcttccgctaacccgggctggcgctgctaacctcacccaacgatccctgctgtcggaaaatgtccagaggcaccatccctgctatgcagagggmatgchagtacaacagccacaaggggtcttcmtgtggccctcaaacaaaaaatcactgcattacatcagcagactgcattggagagaaaggcgc

SEQ ID NO: 35791 - DNA, 309 bp, Homo sapiens
  misc_feature 92: m=a or c
aggatgctatgcaagtcactaataaaggaagacacggacagatgaacttaaaagagaagctttagctgccaaagattgggaaagggaaaggmcaaaaaagacccctgggctacacggcgtaggtgcagggtttcctactgctgttcttttatgctgggagctgtggctgtaaccaactaggaaataacgtatgcagcagctatggctgtcagagagttgtgcttctcaagacaaaggcaagtcctgtttctttttcttttttggggagtgtccttggcaggttctgggtttggacgttattcggtgacc

SEQ ID NO: 35792 - DNA, 130 bp, Homo sapiens
  misc_feature 78: h=a or c or t
ccagttaactcttctgtgcaggatgcgtgtatgcatgtgtgtgtgtatagaagatatttaaggaaaggtaggtaagthcacagtgtggaaggtcttgaatgctgacattagacttttttctgcaggcggc

SEQ ID NO: 35793 - DNA, 259 bp, Homo sapiens
  misc_feature 244: m=a or c
cctgggtaacatcgtgagaccacatttctgcaaaaataaaatacaaaacttagccaggtgtagtggcatatacctgtagtcccagctacttgggaggctgaagcaggaagatcacttaagaccaggagtttaagactgcagtgagccattattgtgccactacatgccagcctgggcaacagtgagatcccatctctaaaaataatttaaagaccagcttaggccaggtacagtggcacacacmtgtaatcccagctga

SEQ ID NO: 35794 - DNA, 266 bp, Homo sapiens
tcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgca

SEQ ID NO: 35795 - DNA, 175 bp, Homo sapiens
tcccaatttcagtgaatggtaccactgtcagcctagtcacgtaagccaaaaactttggcagcttctttcttacgcttttctgttatgctcatttccccttagtccagttagtcacaccaagtcctgttaattttaattcctaaatatcttttaaatttattttttcctgtgtcat

SEQ ID NO: 35796 - DNA, 131 bp, Homo sapiens
aattcgcggattctggtttctgaaggctacgccggaattccttccccgggacttgggaaccacttctgcctccctccctggggcgtggaggctgaggaaaaggagtgcctccacttctcattcagagaatt

SEQ ID NO: 35797 - DNA, 273 bp, Homo sapiens
  misc_feature 46: m=a or c
  misc_feature 227: y=c or t
tccgatacaaaggagaatctgtccagggtgctttgatccttgcagmgctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactgggtatttttcttaycccttgactctgatagtaaacctggccctctcagcagttgacgcct

SEQ ID NO: 35798 - DNA, 58 bp, Homo sapiens
  misc_feature 54: r=a or g
gcagcctcctgcagggggacgagatttggaatgccctgacagataattatgggratgt

SEQ ID NO: 35799 - DNA, 303 bp, Homo sapiens
  misc_feature 133: w=a or t
  misc_feature 155: y=c or t
tttagattccttctataattgttcttatagataagtaatttatatatgagctgtgttagtattttttcagtgtgagatctctggattctttcacaataaagctgttgaattttaacaggagtattagtacatwaaattttctactcaacaattcygagataggattatgcctagtttgtcatatcacagaaaaactccaagttaacttcatgttttggaagggcaggtcgtttttaaagtatttctttttttaactggatgaaaaatcttcatgttaggattaattttcttaatcacccccac

SEQ ID NO: 35800 - DNA, 206 bp, Homo sapiens
  misc_feature 183: n=a, g, c or t
gagagcaacaaagttagagtctgcgggccgcactcgcctgcgccccgcacccctccgagcagcccggggatccagcacgcaggtgccagaaccctgtggagcatcatgaactgggaagagtagctgagcccccagagcctctctggaagagaaaggaagagccagcagttctttctcccaggntccgacctcaccgtccagcgtca

SEQ ID NO: 35801 - DNA, 264 bp, Homo sapiens
  misc_feature 176: n=a, g, c or t
tatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcnagtttattataaggaatgctgccatatagagaaagctgaagagaaaccatgggcagaaggcttttttctgtcttattacactgaacca

SEQ ID NO: 35802 - DNA, 443 bp, Homo sapiens
  misc_feature 136: k=g or t
  misc_feature 316: m=a or c
aattgatcattgtgagaataaactgcataataattttgttattatcaaatcaaaacatacctaacccaaaggttgctgcccttcaccagccaataggtacaattaggcttgtgttcacattatcatctggaaatckcattggcttagcaccccatccagtcaggcaagaattacagtctctggccgggtgcggtggctcacgcttgtaatcccagcactttgggaggccgagggggcggatcacgatgtcaggagatcgagaccacggtgaaaccccgtctctactaaaaatacaaaaaattagccggacgtggtmgcgggcgcctgtagttccagctactcggggggctgaggcaggagaatggcgtgaacccgggaggcggacttgcagtgagccgagatcgcgccactgcactccagcctgggtgacagatcaagactcc

SEQ ID NO: 35803 - DNA, 341 bp, Homo sapiens
  misc_feature 130: m=a or c
  misc_feature 132: v=a or c or g
  misc_feature 333: k=g or t
atccagtgctttgtaaaggaatcttattgtccaccccgtgtcttggcaaaagaacagtgatcacacagattcctacttgggctctttcctttaatcttcggaggctgagtttgcccaactcaggtttaamcvaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttkgaaagctt

SEQ ID NO: 35804 - DNA, 242 bp, Homo sapiens
  misc_feature 126: r=a or g
  misc_feature 129: k=g or t
  misc_feature 130: y=c or t
  misc_feature 136: v=a or c or g
  misc_feature 137: r=a or g
gttttggtgtgctgctggatgaccagaccgggcgtcgggtgagcccagaagtgagagcagttggctgtgccccagtgctgtgtgacccagaggcgccgctcaccctctctgagctggtggacatcrtakygggtgvrgcccagaactgtcttctgaggaagaggtgctctcctgggcccccactgtccccaggcctcagcagcaaggcaagtgaggtgctgccgtcatccaggctggacagt

SEQ ID NO: 35805 - DNA, 135 bp, Homo sapiens
cgaaattaaaattactcttccaaagtgcaactctaatcatggcacttaagggattttcctttacttacttttcaaatgaagtttcttctgtctatcctggatgtttgaaaggcattccatggcctaagccccaac

SEQ ID NO: 35806 - DNA, 421 bp, Homo sapiens
  misc_feature 125: r=a or g
  misc_feature 127: k=g or t
  misc_feature 129: r=a or g
  misc_feature 130: r=a or g
  misc_feature 142: r=a or g
cccagtgggaaagcaagggaggatggaagacttcttgggcagtttacgaagtgtggagacccagttccctgttagtgcttttccttatcagagatcattacctggtagaaaaggagatgttctgrakgrrggattaagctaratatagtaagtcacagtgatatggacatttgaaagtaattgcttgggaaatgtaaagaggtcacagtggttgaacttaatggtacaaagaataaccatggggccaggggcagtggctcacgcctgtaatcccagcactttgggaggctgaggcagtggatcacgaagtcaagagatcgagaccatcgtggccaacatggtgaaacccatctctactaaaaatataaaaattggccgggtgcagtggttcacacctgtaatcccagcactttgggaggcc

SEQ ID NO: 35807 - DNA, 68 bp, Homo sapiens
  misc_feature 9: m=a or c
  misc_feature 35: m=a or c
attctgggmaagggcaatttccgttaggtgctgamggctgtggcgcgcggctgtccccattcccacgt

SEQ ID NO: 35808 - DNA, 265 bp, Homo sapiens
  misc_feature 123: k=g or t
  misc_feature 125: k=g or t
  misc_feature 142: k=g or t
  misc_feature 186: k=g or t
cataccatccatccctggtgaaagagtaaaaccaaaggttattatttcctttccatggttatggtcgattgccaacagccttataaagaaaaagaagcttttctaggggtttgtataaatagkgktgaaaactttattttakgtatttaattttattaaatatcatacaatatattttgatgaaakaggtattgtgtaaatctataaatatttgaatccaaaccaaatataattttttaacttacattaacaaacatttgggcgc

SEQ ID NO: 35809 - DNA, 130 bp, Homo sapiens
  misc_feature 129: k=g or t
  misc_feature 130: s=g or c
aaagatattctttttttttgagatggagtttcattcttgttgcccaggttggagtgcaatggcatgatctcagctcactgcaacctctgcctcccaggttcaagcgattctcctgcctcagcctcccgks

SEQ ID NO: 35810 - DNA, 148 bp, Homo sapiens
  misc_feature 123: r=a or g
  misc_feature 132: s=g or c
tacttcaattgtacattttggtaattcttggcatttgtagctctataaaaccagcaacatattaaaatagcaaacatatccattacctttaccaccaaagttttcttgtgttttttctactcrcttttttcstgcctatccccccctc

SEQ ID NO: 35811 - DNA, 310 bp, Homo sapiens
  misc_feature 114: r=a or g
  misc_feature 129: r=a or g
  misc_feature 131: r=a or g
  misc_feature 135: s=g or c
caaactctccattgatctatactacattctgggctgaaggttttcttattctggactatgaagaaaggactttcaaggagatatagtgtgaacaggatcaggaaggtagagggrttatatttacttaargrggascaagctctatattaggatattgttttgaagcagatggatgccgttaattgctaataagtcttagttattaacgcaggctcatcagggcccccccttggaaatatttgatcagtggtcttttacaagtgatggtatatatttctttctaggtggtgtataatcaagactccctacc

SEQ ID NO: 35812 - DNA, 166 bp, Homo sapiens
  misc_feature 120: s=g or c
cttgtcacccaggttggagtgcaatggtgcgatcccggctcgctgcaacctctgcctcctgggttcaaggattctcctgcctcagcctcccaagtggctgggattacaggcatgtgccascatgcctgggctaattatttttgtatttttagtagagatggggtcg

SEQ ID NO: 35813 - DNA, 146 bp, Homo sapiens
aacttttaaaatagtttaaatctcccattttaatagtgataaggaaacctgttaaaatcatggctattgatgttatagtatggaaagttgaactttatgaacccatacttttaaaaagcatttttaaaaaatctaacactgactac

SEQ ID NO: 35814 - DNA, 184 bp, Homo sapiens
tgctctgttttggaatgggagaggctgggctcaacttgttgaccactcccatttttgtatctcttggctatcaggcactgtgtaaggccctccacagtgatcatttaatcctcagtcatggttgtctttccaataacagttgaggaaacaggcttagagtatttaaataacttgagagaagacg

SEQ ID NO: 35815 - DNA, 381 bp, Homo sapiens
caaaaatcaaatcaaaatgaattaagacttaaatttaagtgctccactgtgagactgctgcaagaaaacgttgaagaaactccccactttcatgtggacaaaaatttcttgagtaaaaccccaataaggcacaggcaaccaaagcaaaaatggacaaatgggatcacatcaagttaaaagctgcggctcagcaaaggatacgattaacaaagtggggagacaacccatagaatgggagaaaatatttgcacactacttgtctgacaagggattaataaccagaatatataaggagctgaaataactctatagaaaaaaatctaatctgattaaaaaatgggcaaaagatctgaatagacatttcctaaaagaagacataca

SEQ ID NO: 35816 - DNA, 126 bp, Homo sapiens
  misc_feature 34: s=g or c
  misc_feature 35: b=c or g or t
  misc_feature 125: s=g or c
gccacgcaagagaaggtgccaggggacgcagagsbactagaggcgcgcggtcccggccagcaccgtctctggcgttgtagctgcggccgtggcggaggactacggcgacaaggacgaggggcacsg

SEQ ID NO: 35817 - DNA, 373 bp, Homo sapiens
  misc_feature 125: m=a or c
  misc_feature 340: w=a or t
  misc_feature 341: k=g or t
actaatagaagagataattattgaataccttggaatatgtagtgagaagaggccaaatttttcatgtttgtgagcatgtctttcagatactcgctaatggagaaattcactttagacctctagamccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcwkagagatctttaagtatcctaaaatagcagcct

SEQ ID NO: 35818 - DNA, 360 bp, Homo sapiens
  misc_feature 205: n=a, g, c or t
atctacgtgagtgctgccgcgggaaggctgtgggggatgaggcctggcgcggacaagatctcagtttacccaggtgtaaagtgggtggggcgagcggccgctggttccggggcccttcacggaggaccgttggcccagcgcaccccttgcccgtgatacaggagcacgagtgcttccaggaggagctgaggaaagcgcaaagganattactgaaggtgtcccgggacaagagtttcctcctagaccgacttctagcagtacgagaacgtggatgaagactcttcggactcagatgccactgcatcatcagataacagcgagacggaggggacacccaagttgtctgacacaccggccgca

SEQ ID NO: 35819 - DNA, 365 bp, Homo sapiens
cataattgacatctggattgggtttatgtttgatgcattgtttggaaaatttgcaatacaaactggcataagaattacttattctgatgatgcacttttatgtatttttcattagaaagtagaaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtc

SEQ ID NO: 35820 - DNA, 187 bp, Homo sapiens
  misc_feature 123: y=c or t
tttgagtaggtcttactagcagtgtcttaagtgcctagttcctttttgttcataaatgatgatctggtttaatactgcagagcattttaagctaagcattttgagaacagcttctgcctttcytttttcttgtggcagcgtgttgctaaagcgcttacagagacactggtacatcaaacagggccaa

SEQ ID NO: 35821 - DNA, 156 bp, Homo sapiens
atgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggagga

SEQ ID NO: 35822 - DNA, 228 bp, Homo sapiens
tgctgaaaactagaaaaataaaaaatcttaaaagtaactggaggagggaacaaaatttaaaagctgtaataagactgatacctgatgacacattagaaaaagttgaatcagaagacaaaggcatgatatctttaatgttgtgaggaaaaataatcactaactctgtattatagccagataaaagtatacttcaaaagtgagagtgaagtaaagacatttccagacggc

SEQ ID NO: 35823 - DNA, 470 bp, Homo sapiens
  misc_feature 432: r=a or g
ctaagtgtgaggtttaagatgctgtattgaccctatgagtttttaatgtgttaattatctttatagcataatagatcgctttaggttcctggaatcccatttggtctgacaggatatatgaagattcttaatacctattttctgtgtctaatacttggttaatactaaaaatagaaatgactaaattacatcacagaaagcataaccagtgattgaacctggtagttttaaagctctaaatagctgtggctgaaggactgattatggggctaagaagcttgaaacgtaagttggtacttgttcatcagtggattctcctaaattaagccaaattttgaaatacatgactattaagtttctactcatgtatttacagtcagtcaataaattaaaggaggaaaaaaatccctgaacaacctgcccataaaaagraaaatactctacatttgagcctgctgcagttttaaatt

SEQ ID NO: 35824 - DNA, 102 bp, Homo sapiens
  misc_feature 2: r=a or g
  misc_feature 59: k=g or t
  misc_feature 60: s=g or c
  misc_feature 61: s=g or c
  misc_feature 70: v=a or c or g
  misc_feature 72: n=a, g, c or t
  misc_feature 73: n=a, g, c or t
trtggctctttgccatcaacgtatatttcaacgccttctggaccattccagtctacaaksscatgcatgvgnncctgaaatacgacttcttccagaccatgt

SEQ ID NO: 35825 - DNA, 110 bp, Homo sapiens
  misc_feature 89: w=a or t
tatgcattattttgttgctgggaaagtaatccttctcttctcttatccatcatgttgtttgtgtttcttggtgtacaggagagtaagcwatttatttaagtgctttgagt

SEQ ID NO: 35826 - DNA, 396 bp, Homo sapiens
  misc_feature 131: r=a or g
caaggcatctaccggcccctcacagagacagtactttgaaactcatgttgagattttaccctctcctccaaccattttgggaaaattatggactgggactcttcagaaattctgtcttttcttctggaagraaatgttccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaag

SEQ ID NO: 35827 - DNA, 121 bp, Homo sapiens
caactcttgaagaacttttatttcacatcagattttcaacacattaatttgtaaagtaccttgagtgtaatttttatatgcttaaaaaagaaaaaatcatataagaaagatgggataacca

SEQ ID NO: 35828 - DNA, 349 bp, Homo sapiens
agtgtagactgctaacaccttaattttagcccagtgaggcccacatcagacttctaatctacagaactacagtgataatacgtttatgttgttttaagtccctgagcttgtggtaattttgttacagcagcaaaaggaacctaatacacgaagggcaataatagtgccttcctcttgaggtggctgtgagctttacatgaattatgacatggcagcacttagaacagtagatggctctgccaggtatggtggctcatgcctgtaatctcagcactttgggaggctgaggctggtggaccacaaggtcaggagttcaaaaccatcctggcaaacacgatgaaaccccgtc

SEQ ID NO: 35829 - DNA, 205 bp, Homo sapiens
  misc_feature 123: k=g or t
  misc_feature 128: y=c or t
ggtgcccgtcctgtagctttccggctctgttggacagtgatgtgaagaggttcagctgtcctaatcctcactgccgaaaggaaacctgtaggaagtgtcagggactctggaaagaacataatkggctycacctggtgaagagctggctgaaaaagacgacatcaagtaccgtacctctattgaagaaaaaatgactgctgccccc

SEQ ID NO: 35830 - DNA, 197 bp, Homo sapiens
  misc_feature 121: r=a or g
  misc_feature 127: k=g or t
  misc_feature 189: n=a, g, c or t
ctgtatatttgcttactgtgccgttttagtggttttaggataaaaatgcactggtgaagcaaatgtagtgccaacagaaggtgattttccagttgtaaatgtcatgcagcatttgaagggrctgtgktttccttaaaaaaaaatcacagttacttctaaaccagatttcatttcttttattgttttatntagccaaa

SEQ ID NO: 35831 - DNA, 215 bp, Homo sapiens
  misc_feature 156: r=a or g
gattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgrccagtttagacactgctttgttagagtaaaatgattaggtacctagtatcaacctagcc

SEQ ID NO: 35832 - DNA, 70 bp, Homo sapiens
  misc_feature 31: s=g or c
  misc_feature 32: m=a or c
  misc_feature 70: h=a or c or t
gcagatgaggcagttcggctggggccagcgsmgctttggaacccgaggtggggggacctggcggtggggh

SEQ ID NO: 35833 - DNA, 375 bp, Homo sapiens
  misc_feature 93: w=a or t
  misc_feature 98: s=g or c
  misc_feature 101: s=g or c
  misc_feature 121: k=g or t
  misc_feature 124: v=a or c or g
  misc_feature 137: r=a or g
  misc_feature 164: k=g or t
  misc_feature 207: k=g or t
  misc_feature 267: k=g or t
  misc_feature 268: k=g or t
  misc_feature 314: y=c or t
  misc_feature 315: m=a or c
  misc_feature 316: r=a or g
cacatttaggtttagaatccacctggaattggtcctggtagatggtgtgaggtagattctactttaattgtccccccacatggatggccagtwgtctsaastcttccctgttgatccgtgkgtvacctctgtcatarcactcatacatgaagtgtttgtatatktctggttcttgactttctcttcttttactattgggtgattttkatgcctcaagactacactgtcttatatactcgtaacttccccgtaggtcttgatatgtgkktgagcatttcatgttcctcacgttgtaatcctaacttagctgattymratattacatctatgtagatagatggtaagcgctttgtactcttcacttcaacatgtatt

SEQ ID NO: 35834 - DNA, 340 bp, Homo sapiens
  misc_feature 98: k=g or t
  misc_feature 101: k=g or t
  misc_feature 121: k=g or t
catagaaaacaatgtgaatatttaaggtctgtgactatagttaaacttcactaagaatttgcagaattgttttgagatgtgtgaataaaggtaatttkatkgaatcttcattggtgctaakgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaa

SEQ ID NO: 35835 - DNA, 249 bp, Homo sapiens
  misc_feature 8: n=a, g, c or t
  misc_feature 231: r=a or g
caattganattattcaatctgtagaacagggagtgaaaggatttttaccgaatgaacagagcctcagtgacatgtaggacaatttcaaatgggttaacatacatgtggaacactagaaggataaaagagtgagaatgaagcagatgaaagacagtttttaaaaatggccaacatatttctataatttaatttgaaaccatgaatctttgatttacaaatcccagaaactargtgaaaccaagcaggagt

SEQ ID NO: 35836 - DNA, 223 bp, Homo sapiens
  misc_feature 3: n=a, g, c or t
ttntgttttgtttttttggtttttttgagatggagtcttgctctgtcgccaggctggagtgcagtggcgcagtctcggctcactgcaacctccacctcccgggctcaagtgattcttctgccttagcctccagagtagctgggactacaggtgtgcatcaccacgcccgtctaacttttgtatttttttgagtggagatggggtttcaccatatcggccaggt

SEQ ID NO: 35837 - DNA, 278 bp, Homo sapiens
  misc_feature 1: w=a or t
wtacatttcacagaagggtaaacgaggcgtaggtggtttgagtgatttgcttgagatcgttcggctaataaagcaaaattgggacacaaggcttttgtcatttttaaaaaacataatattgaaggcctggtatgttccgaaccctgtgctgaggctaggaatacaaaaaaggaccaggccggtgtggcctctgggctagaggagcaggggtactccggaggctagaggggagagaggggacgatagtgactacaaattaagtaaatgtgatcatgacc

SEQ ID NO: 35838 - DNA, 56 bp, Homo sapiens
  misc_feature 14: w=a or t
  misc_feature 33: k=g or t
agcaatgatactawacaactctctgaaatttckcaagcaccaagagaaacatcatt

SEQ ID NO: 35839 - DNA, 195 bp, Homo sapiens
  misc_feature 89: r=a or g
  misc_feature 95: r=a or g
  misc_feature 107: r=a or g
  misc_feature 112: k=g or t
  misc_feature 122: k=g or t
  misc_feature 177: k=g or t
ttgctgaaataggaaaatgagccttattgacaattaagtgcttcttgcagcaggtggtcaaagaaaagcatgactaatacgacctattrgagtartctacatctggrccatkccttaagttkttcctcaccgacagtaccatcatgccttgagtgttcttttctcccaagtgctatkccttaaacacgagagttt

SEQ ID NO: 35840 - DNA, 72 bp, Homo sapiens
gctcatttgcagacatatgggtgattggtacagtaggtttataaacagaagtttaaacttgtaagcttaagc

SEQ ID NO: 35841 - DNA, 98 bp, Homo sapiens
  misc_feature 97: k=g or t
  misc_feature 98: k=g or t
taaaagtgtgttagttcccggtcacctgagctccgggtgacgcggctgcggtagctgcggatacaagccttccgcgggtcctgcctgacgaccccgkk

SEQ ID NO: 35842 - DNA, 169 bp, Homo sapiens
  misc_feature 73: k=g or t
  misc_feature 83: k=g or t
  misc_feature 86: k=g or t
  misc_feature 91: k=g or t
  misc_feature 94: k=g or t
atctaaacttaaggtcagaacagaaattcatgtgctgaacagaatggattctttttgcagtaccaatccaatkgaatcctctkttkatttkcckgcgtccttaccagtcactttgatagtgctaactaacctacactatgggggttattcatgaattaagtatgataaa

SEQ ID NO: 35843 - DNA, 65 bp, Homo sapiens
  misc_feature 18: w=a or t
  misc_feature 44: k=g or t
  misc_feature 56: k=g or t
  misc_feature 64: k=g or t
aaggtctgttatgctgtwcccgctccaggtggccgctgtaacckcttcggtccgckacgatcckc

SEQ ID NO: 35844 - DNA, 324 bp, Homo sapiens
cttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtaaaaaacacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccc

SEQ ID NO: 35845 - DNA, 220 bp, Homo sapiens
  misc_feature 62: k=g or t
  misc_feature 68: r=a or g
  misc_feature 73: r=a or g
  misc_feature 79: r=a or g
  misc_feature 80: r=a or g
  misc_feature 90: w=a or t
  misc_feature 91: r=a or g
  misc_feature 97: r=a or g
  misc_feature 106: k=g or t
  misc_feature 112: r=a or g
  misc_feature 113: d=a or g or t
  misc_feature 131: b=c or g or t
  misc_feature 208: m=a or c
  misc_feature 217: k=g or t
atctaaggagtatatatatatatgcccccttgtggttaattattgctcctttaataattttkacttgraatgrtccacrrttatttcatwrcctttrgcagtgtgktttggrdctactgtacttaaaggtbtgtttgtttgtttttgccatactgtataatttgggtgaggtctacaaaattgggtgtgactttcctttgcaaatggmtttctcctkgga

SEQ ID NO: 35846 - DNA, 111 bp, Homo sapiens
  misc_feature 52: w=a or t
  misc_feature 56: h=a or c or t
  misc_feature 65: w=a or t
  misc_feature 72: s=g or c
  misc_feature 73: m=a or c
  misc_feature 80: w=a or t
cccaacctcagactccaactccaagtcctatcatctctccttcagccatgcwtcchatctacccwgccattsmtattgawgcacagactgagagtaatcatgacacggcgc

SEQ ID NO: 35847 - DNA, 359 bp, Homo sapiens
tgtacaatcagttctccatatctgtggattcaactaactgtggattgaaaatacttgtgaaaaaaattgcatctgtactgaacgtatacagacttttttcttgccattattccctaagcaatacagtaggacaactatttacatagcatttacattgtattaggtattggaggtaatctagagatgatttaaagtatatgggataatgtgtgtaggttatatgcaaatactgtgtcattttatatcagggacttgagcatccatggattttggtatccttggaaggtccaggaaccagttccccacagataccatggggcgacagtattcagaataatgctagtagaatcggccgaggt

SEQ ID NO: 35848 - DNA, 242 bp, Homo sapiens
  misc_feature 45: w=a or t
  misc_feature 97: w=a or t
  misc_feature 103: w=a or t
  misc_feature 117: w=a or t
  misc_feature 151: w=a or t
  misc_feature 195: w=a or t
ggagcgcgatggcgggggcggcgggactcacggcagaagtgagcwggaaggtcttggagcgaagagctcggaccaagcgctcagttttaaaattgcwatagcwtagcctgcgacgcwtatgattagagccaacaatttgaaatggcctgcwcacctgatgcagtcgtctctccgtcttccgctttcttaaggtcwggctcagtttatgaacctcttaaaagcattaatcttccaagacccca

SEQ ID NO: 35849 - DNA, 193 bp, Homo sapiens
ttctcgtgcctcagcctcccgagagtagctgggactataggtactcaccaccacgcctggctaatttttgtatttttagtagatacggggtttcaccatgttggcaaggctggtctcaaactcctgacctcaggtgatccacccgccttggcctcccaaagtgctgggattacaggtgtgagcccagccccac

SEQ ID NO: 35850 - DNA, 209 bp, Homo sapiens
ctgaaataggaaagtaagatttatacccattattcagccaaaatctgtttttctttaacttctacccattgttcctaagtctgccctctgggggctgtagaaaataatgaagatgatgttattaatgataaccagtgcttgctgtaaccagttatgtgcattattttattggatttaatttgtttactctttataacagcatgtgtggg

SEQ ID NO: 35851 - DNA, 207 bp, Homo sapiens
cagatgagataaagctcatagctcatagtaattgcactttttgaagagtattatcttgcgtagtgtacataatatgcttacgtgtcatgtaggagccatgaagttttgaagaacttcaaaaggaaagaaggttgaggctaaggaagatgcaatgtggctatgtatataggttctacaatttaaaaattaaaaatggaatgggagggt

SEQ ID NO: 35852 - DNA, 465 bp, Homo sapiens
  misc_feature 77: m=a or c
  misc_feature 370: r=a or g
atgatttgattccctactctcattttttaaagcatataaatatttatgggcttaaaaagggggtttttaaaaactgmggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaatcacaatgtgtatatgttcattttctaggtatgataaaagaatgtatggctttttattctgtggaagtaaaatcctgracgtttacaacttttccttaacttgtaaataaaaaattgtaagttttttctttttttacagaaaacttagcttgtgtaattctgttagtttcaga

SEQ ID NO: 35853 - DNA, 235 bp, Homo sapiens
  misc_feature 137: n=a, g, c or t
  misc_feature 138: d=a or g or t
  misc_feature 172: k=g or t
  misc_feature 221: d=a or g or t
cctagatttgtaatactctgatttgaacttttaccagcttaccgttaataacacagaaaaactctgatcttatacaactccatccccaacacttgtagatagtaatgtcacaaaattacctctttatacattgtgtndccaaaaacatagattaataattttttaacacatkcgtctcttaaatcacataaaaaacaaaaagtggagtacaaaccaaagtdacaataatatgaac

SEQ ID NO: 35854 - DNA, 275 bp, Homo sapiens
agagagaaagagagagagggacttgagttctgttatcttcttaagtagattcatattgtaagggtctcagagggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccac

SEQ ID NO: 35855 - DNA, 368 bp, Homo sapiens
  misc_feature 145: m=a or c
  misc_feature 203: n=a, g, c or t
  misc_feature 214: m=a or c
  misc_feature 245: m=a or c
  misc_feature 296: n=a, g, c or t
  misc_feature 332: s=g or c
tgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggmagtcagctgttaaccactcacttagtaaatgtcataactacacctgctccaggaccantcagtgaaacmtgctcggaattaaaggcttcctctgggtgcmtgctgaacaactgagctcatgtcatgggcatgtggtggtttctctgttgcnttgaaaggagccattaaagtcagtcgtgcgtgaagsatctctcttctaaaggatgtgtatttccataaatgc

SEQ ID NO: 35856 - DNA, 247 bp, Homo sapiens
  misc_feature 78: w=a or t
  misc_feature 169: h=a or c or t
  misc_feature 213: k=g or t
ttatgattttttcctacggaggtaaatgcctcattcataattttgaaatgtaaattaattttcttttcatatgatgtwttgatttcaatgtattagattttaatacatagaaaaatatattttgtgtaagtacttgcttcaaaagaattaaaaatcaacatttataachtcaggtgaatgagatattcataatttttttttggcctcactackcatctcctaaactacagtcccatttttcttactc

SEQ ID NO: 35857 - DNA, 136 bp, Homo sapiens
  misc_feature 11: w=a or t
  misc_feature 63: k=g or t
  misc_feature 67: r=a or g
  misc_feature 78: h=a or c or t
  misc_feature 85: h=a or c or t
  misc_feature 92: h=a or c or t
  misc_feature 99: r=a or g
  misc_feature 123: y=c or t
gtgaaacaacwgagagaaaattttcaggaaaaaagacagtggctcttgaagtatcagtcactkttgrgaatgtttcthagttachgcatachtcatggrtcccatggtgggggtcttgcatcygtaagaatggaat

SEQ ID NO: 35858 - DNA, 138 bp, Homo sapiens
aaggtccctcataaacagcagggttgcgcttggaatcctgatctgtctctaacttctcatttgcagataaagaaactgaggccaaagtacacaactaatttgccagcgtaacagctggagacttaaatgacaccaagc

SEQ ID NO: 35859 - DNA, 292 bp, Homo sapiens
ttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtccc

SEQ ID NO: 35860 - DNA, 189 bp, Homo sapiens
  misc_feature 146: h=a or c or t
  misc_feature 147: n=a, g, c or t
agttcccaagtaataagcctgggaatgttttcagtgcagcagccgggagaagaagggggattcagcagttgctgttcaatgcatttactctctacctgctggcttcaaacagtattaactttatttgctccttgtgcattgtgtchnaattaaaagcagttctcttcacagaggcacttgtaggatttt

SEQ ID NO: 35861 - DNA, 141 bp, Homo sapiens
cttcttttcctacatatttcctcacttagcagtagctagtgtagttattttgtggttattttatttcattctctaggatctattccattaaggatgcaagtgtgtagatgcatatatatcatttgcttctttcttccgccc

SEQ ID NO: 35862 - DNA, 80 bp, Homo sapiens
  misc_feature 17: r=a or g
tggtttccaatgcttcrgagacttcctgcctaggcctcatcctcctctttgccagtcacctgattaaccaattctccagc

SEQ ID NO: 35863 - DNA, 399 bp, Homo sapiens
  misc_feature 86: w=a or t
  misc_feature 88: w=a or t
  misc_feature 100: v=a or c or g
  misc_feature 287: b=c or g or t
  misc_feature 325: y=c or t
  misc_feature 357: k=g or t
  misc_feature 360: k=g or t
gaatatagcagcatgaaactactggtgaaaagccagagcagaacgatgatgacaccataaaatctcaggaggaagatcagccaatwawttattaaaaggvaaagaggaagacctcgcaaataccctgtagaaacaacgttaaaaatgaacgactccaaaacagatactggcattgtcactgtaagtaattgcaaaacatgacaatttcaaatacttgctcttaacctgaaaaacggtataatgcaatatctagtattttgaactttattttttttacttgaaaagcbttaaaagactgagtaaccattcatatattttgattacyagtatctttgtgtaaacagagttacattagtkgtkcttcattctgattccattctaattcaggagtttgattat

SEQ ID NO: 35864 - DNA, 313 bp, Homo sapiens
  misc_feature 10: v=a or c or g
cattctggtvttctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagatac

SEQ ID NO: 35865 - DNA, 418 bp, Homo sapiens
tcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacaccagacg

SEQ ID NO: 35866 - DNA, 181 bp, Homo sapiens
  misc_feature 105: h=a or c or t
tttcctaggtaagagcagatacttactgtaaatcctgcccctagattaaacaaccttggtgttatcgtacttccattgtcctatacatcccttcggaatccccchttccctatggtcctcaagcccttggtctggggagtaacagcatagggatcaaccatctcgtcttgccactgccctc

SEQ ID NO: 35867 - DNA, 187 bp, Homo sapiens
  misc_feature 93: r=a or g
agagggattggcaagcttgcgtgccccagcgacacaggcctcgaggctgtctctgacaagtgttcacaggaggtggggacgcctctgcgcgargaacgaggagctacgggcctgggcccggttattgccatgggcagcggctgccgcatcgaatgcatattcttcagcgagttccaccccacgccga

SEQ ID NO: 35868 - DNA, 195 bp, Homo sapiens
agacactgaggatcaggcagagagagaggctcctgccaggctgagcttttccggagtgtggatatgaacagccgtcttgggtcctgaggtggaagccatgtgtggaagatggagggcatcggttagaaggagtctagtccctgatggtcactgagctgcagaaccagcctgggctgcttcctgctggatgtcact

SEQ ID NO: 35869 - DNA, 142 bp, Homo sapiens
aacaaggatttcaaagtagctgctacaactatgttcaaggagatgaaaagaaaaaaagattgaaaaagaatgaatatccccagagatctatgaacaatataaaaaaactatcataaacggaagtagagtcccagcagggaaa

SEQ ID NO: 35870 - DNA, 85 bp, Homo sapiens
  misc_feature 11: r=a or g
  misc_feature 38: k=g or t
  misc_feature 42: k=g or t
caccagcccgrcacccgtgaaggatctgtgctgagtakgatkagtaaaagaggaaggcctctgtctcctgccttcccctgggaac

SEQ ID NO: 35871 - DNA, 273 bp, Homo sapiens
  misc_feature 91: k=g or t
  misc_feature 99: r=a or g
  misc_feature 110: r=a or g
gacggcgagcggcgggcggcggaggaggagacggcaggtcgggcattaaaaaatatttaatcattcatgtgttgagactcattcttgagtkatggatgrcaaggcttctrttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctaca

SEQ ID NO: 35872 - DNA, 416 bp, Homo sapiens
  misc_feature 38: k=g or t
ccttgggctccaaattctagctcataaagatgcaagtkttgcaatttcctataaatggttaagaaaagagcaagctgtccagagagtgagaagtttgaaaagagaggtgcataagagagaaatgatgtccatttgagccccaccacggaggttatgtggtcccaaaaggaatgatggccaagcaattaatttttcctcctagttcttagcttgcttctgcattgattggctttacacaactggcatttagtctgcattacacaaatagacactaatttatttggaacaagcagcaaaatgagaactttatttggtgcagtcagggctccatttagttccctcactctgcttctaatcaccccttctcccagccctcttctatttgatagaggtctgtccctcagatcagcaatgtc

SEQ ID NO: 35873 - DNA, 376 bp, Homo sapiens
  misc_feature 2: v=a or c or g
  misc_feature 25: w=a or t
  misc_feature 40: d=a or g or t
  misc_feature 267: n=a, g, c or t
  misc_feature 325: n=a, g, c or t
  misc_feature 326: k=g or t
  misc_feature 328: m=a or c
gvaaaagcgaccccacattcaaggwcgccaatggcatgtdgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtgnctcacggaccccactttgagaaacgcagactgggctgtttgccttcagaagctggaankgmaattggtattttgaggagaactgaatcactttgcaaagaatgtatgtt

SEQ ID NO: 35874 - DNA, 175 bp, Homo sapiens
  misc_feature 69: s=g or c
  misc_feature 70: r=a or g
  misc_feature 82: k=g or t
  misc_feature 91: r=a or g
  misc_feature 93: r=a or g
  misc_feature 94: k=g or t
tattaacatacctctccatctacattttttctgtatctatgtattctacataaataatataatgtacasrtatatgtgtggkgcgtacatrtrkactaatgacttcagctttctaggtgtttacagaaaaacaagtggataaagtgggtagaaaattacttcaatatgtgggtct

SEQ ID NO: 35875 - DNA, 124 bp, Homo sapiens
  misc_feature 89: r=a or g
  misc_feature 90: r=a or g
  misc_feature 96: r=a or g
caaagatctattggaacagaaaagcaagttgaccatagaagtggctgaacttcagagacagcttcaactggaagtcaagaatcaacagrrcattaragaagagagagagaggatgagagcaaac

SEQ ID NO: 35876 - DNA, 256 bp, Homo sapiens
aggggcatgatcagagtctctataacttcctgattaacaatacagtgtatcttgttacccagctgtcagtctttgagagctttcaagtaaaaatatagtaaattctttcagcataggctaatgtgtggttactgagatgagtgttgtgtactcagaaccgtagcaacatttttatgaatggtaaaagtacaagaggaggaaaagttaaaattagaagaaaagtacaagttattgcttaatcataaatcacaccaca

SEQ ID NO: 35877 - DNA, 182 bp, Homo sapiens
aggcgttccgagcggcggcggaggaaagagaacatcacagaaaggtgaagaaatttgccctaaatcataaaactttgtaagtggcagaacaaggatttgaagctggcagtctggttccagagatggggttttactatgttacccaggctggtcttgaacttctgttctcaagagacccacac

SEQ ID NO: 35878 - DNA, 183 bp, Homo sapiens
  misc_feature 91: r=a or g
  misc_feature 92: d=a or g or t
cttgagctgctgaaatccccaactgacagtgaggtcactgaggaagtatacaggtttttttaaaaaattatttttgaatgtgtgacttagrdaagaattacgtgtgtgtgacaacttaaccttagctctgggttgaccctggcactggattagtttctggtcctgacttgtaaccatggaaca

SEQ ID NO: 35879 - DNA, 285 bp, Homo sapiens
  misc_feature 81: d=a or g or t
aaatactgtgcaggccatgcgtggtggctcaggcctgtaatcccagcactttgggaggccgaggtgggcagatcaccggadgtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaa

SEQ ID NO: 35880 - DNA, 432 bp, Homo sapiens
attcaccacggtgggaaggattcctgctaagcttccttgcctctgtccagctcccagggcgtctgcctccctcctgcccccagggagagcttctgggtgagtctcgctggcactcctgccccgggcttcctgctctcaggccttggcctgctgcaccttggccaactgcaccacccggcacatcatagccccactcaggtcagagctgtgtctcagccgacgtggggttccgaggttctcaccaagatccagactcaacgcttgtgggtttgttgtctcagtcctggcggtggaggttctcccgaggcctcagcgcctctgttctcggaagtctctttacatgttagtggaaccctctgttcctgttgaatcattcttcgtgttaaatgtttctatctcttgactgatacatgatagtcatcatgtatgtat

SEQ ID NO: 35881 - DNA, 365 bp, Homo sapiens
aaaaggaacctttgaatcccaggctgtcgtgttctagagcatgactgtgtcagggagaatgagcgcctggcattcatagaacacagtcctctctcaggccctttcccgtttgccatttcatgacttgctgtactggtggcccttggagaagcagcagtgcatagatcgttgttcccaccttgcagacagggagagtagagcccagagatctctccaaaccacactgcttatttgtggcaaagcattgtggcccctaatgagtttttaaccaccagaagaaataacatttcttaagactgtttttagaggtaacagcagccctttctgaggaattagttttgaatttcaccacaactggaattaga

SEQ ID NO: 35882 - DNA, 59 bp, Homo sapiens
  misc_feature 2: r=a or g
  misc_feature 29: k=g or t
aratagtcttacaaaagacaatgtgcttkatgttatacctatagctttggtcccatctt

SEQ ID NO: 35883 - DNA, 381 bp, Homo sapiens
ttttttaggcagggataaagtatgaagcatggttaagtattataatgataaaattgtcagagatgggagaaatggaatctcatgaaaaacaaaatctttgcctgactgaattagctattacagagatattaggagataaaccatcctaagcctaggtgggcaggggacagcatctgatgaagcagctcttctgaagcttatctgctcacacattttggttcatactgctcttgcgtgagaaaaaaagtggtgggagtgccagggcccagcatattctgtgtttttcagttcagacagccaaatattaggatctgattttcccctgcctaaagttttatgtgatttctgttgtcttgtacaatgtgtgcatcaagataaaca

SEQ ID NO: 35884 - DNA, 387 bp, Homo sapiens
attgagctgcgacccttgttcaacgccgttggcgaacagctgctggaggtgccgagaatctgagtttcggcaagcagccaggtctggaaactaatattttaaaaatgactacaccaaacaagacacctcctggtgctgaccccaagcagttggaaaggactggaacagtacgggaaattggtcacaagctgtttggtcactctcatcttgcaaacaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctca

SEQ ID NO: 35885 - DNA, 215 bp, Homo sapiens
  misc_feature 108: r=a or g
ttagatttactgccttcaaaaagtgcctattctgagcaacataaacgttattccttacatatgtatgtacacacggtacccagagtcgtactgtgcagccttcaaaarcataccatcagaaagagtaggtgctgagataaggaaactttgccaaatgaaagaaagtcactcacttccaatatcccctctcaagcggctaccgtgaaacggcaata

SEQ ID NO: 35886 - DNA, 216 bp, Homo sapiens
  misc_feature 28: s=g or c
tgattaagaaaggaagtataggctaggsacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaa

SEQ ID NO: 35887 - DNA, 398 bp, Homo sapiens
  misc_feature 208: s=g or c
  misc_feature 308: n=a, g, c or t
  misc_feature 312: s=g or c
  misc_feature 392: y=c or t
acagaagcctcacatctcttctgctgcataagggggaacaattaacttcctgcagttgtgagaaagttggaaagaaggagaaagtgagcaccctgtaagataaacaaattctcctgtgaatcagagcctggcagagcattcttggctggcttgggtttttgtgaggattcaatgaatacacatcaagcccttcaagaactatgcgcasaacaatatgagaattcctccagcaacatcaggcatcgttattttgagaccaatcaatgatcccaataggctccggctatggacgtgtgtctgagctccgngcasagcctgggcgccggcgggaaggactcagctccccgggtggctggttagaggctgagaagaagggggctccgcagaaagayagcacc

SEQ ID NO: 35888 - DNA, 79 bp, Homo sapiens
ccttctttgtattgtctgtttaaactataatgtaacacctattttgttttatgtatatatatgaatttttttttttttt

SEQ ID NO: 35889 - DNA, 334 bp, Homo sapiens
  misc_feature 82: k=g or t
  misc_feature 87: k=g or t
  misc_feature 299: r=a or g
tcagcgtacctaaacctttctaaaagtcaaaatacagcatcactttaattagacttgactagaaaaataccaaaaattatckcatcktccaaataatagcctcagtaagtatccctaaccaaaatggcctaattaaattatattttttctctttcttcatttcatttttattatctatacttctagccacttaattactgtgagtaatttcaataacaacaaaatattaacaaaaggatcagtcacttacgaccatgaatcaactccattaactgtacaatgcaaccacacctatagartcttcacaaagaagcctgacttctttaccctcaaa

SEQ ID NO: 35890 - DNA, 369 bp, Homo sapiens
  misc_feature 16: k=g or t
  misc_feature 17: k=g or t
  misc_feature 126: r=a or g
  misc_feature 247: r=a or g
  misc_feature 294: d=a or g or t
  misc_feature 301: s=g or c
  misc_feature 333: r=a or g
aacatgtatagttttkkttttaagacctctaatctctttaatctttttcttaaccatagtgagatagatcttttgcttgaagataacaggaaaataaatctaaactaaaacagaaatactgctgaracttcaggtaattttgaaaagcacaagagatattctcaaaatattaagaaaaaggttgtaagattaaagcttaggattattatggtttttttgtgtgcttgtttttaacagaatgtataaratctcattctagcaactcttatctggctatccagagacatgtctgadacaatgsttatcagatacaagcattagcattccggatgrtgtgatctgaagaactgtttctttttcttccctttt

SEQ ID NO: 35891 - DNA, 189 bp, Homo sapiens
cgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagtgt

SEQ ID NO: 35892 - DNA, 284 bp, Homo sapiens
  misc_feature 87: k=g or t
caatctccgccttccaaattcaagcgattctcctgcctcagcctcctgggtagctgtgattacaggcatgcaccaccatgcccagckaatttctttatttttattagcaacgaggttttaccaggttggccaggctggtcttgaacttctgacctcaaggaatctgcttgcctcagtgtccaaagtgctgaaattacgggcatgagccaccatgcctggccacaaatttttaataagtaaggaaaactcaccagagaagcacaacataatacaaatgtactggg

SEQ ID NO: 35893 - DNA, 181 bp, Homo sapiens
  misc_feature 81: k=g or t
  misc_feature 112: b=c or g or t
agcctgttcctaagagcggtggctgtcgctcacacagatcctgagtggactggagatgggctgccgggggctggcattctkagggatcaagggccacagatctttccatcabagtgtgggaggaggcacagagtcttgctttgtcgcccaggctgccgtccagggttgcgatctcggctca

SEQ ID NO: 35894 - DNA, 144 bp, Homo sapiens
  misc_feature 128: k=g or t
aaaaaggatctaaaagagcttctgcacaccaaaagaaactatctaattgtacgcatcaaacatgtctgtaacattttaaaaggctgtcttaatatttatatcttcaattatgaattgtctcttttggkatttataaagagccac

SEQ ID NO: 35895 - DNA, 336 bp, Homo sapiens
  misc_feature 2: s=g or c
  misc_feature 13: b=c or g or t
cstctttctagcbgtccttttctagtgtgtgctcactcttcctaggaacttttaagacttcctggtacctatgaacatggtctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccca

SEQ ID NO: 35896 - DNA, 111 bp, Homo sapiens
agccggctgggggagggggtgtcggcgcaccgcggagtcctgcgctccgtgagcctggcacccggagcagccgcctccccctccccctgcctagaccgctagaagccccct

SEQ ID NO: 35897 - DNA, 379 bp, Homo sapiens
  misc_feature 149: s=g or c
  misc_feature 229: m=a or c
ttactgcattgactggaaatgggaggcacttcacaattaggaatattgtcaggtcagccaggcgccgtggggatgcttgtagtccaagctactcacaaggctgaggcaggaggatcgcttgagcctgggagtttgaggctgcagtgagstccagcctgggtgaaagagaagaccctatctcaaaaaataaaaaattttaaaaacctgtcaagttagatgttaaagaggmcatgtaaaataaaatctccctaacatgtttatgaaatagctgcaaaaggctgagcgtggtggctcacgtctgaaatcccagcactttgtgaagccgaggtgggtggatcacctgaggtcaagagttagagaccagcctggccaagatggt

SEQ ID NO: 35898 - DNA, 136 bp, Homo sapiens
ctattagtaactgttttataaatttgggagctccagtggtaggtgcataaatgtttgggattgtgatattttcctgttggacaaggtcttttagcattatataatgtccttctttgtctttttcttcttcttcttt

SEQ ID NO: 35899 - DNA, 401 bp, Homo sapiens
cactcagggcagccattccattacagcatctcaaagattgccaggaagcagatacaaagaatcctaagtagcctgaaggacaacgttcccactgaaaaggtcaacttgacccttgagatattatttctacttttccaacaatatcaacttggaatgagttttaagtgaaactagtattttagacacccaatacaaagctgctgtttcatcaccatgaagttgggttaaagagtttcttcgactcccttccccaaagctgtttgctttcacttgatgatgctttcacttgatttgaatgtatgccagaaatggaagtttctatttcataagtacataagcatctgagattgtcaggcatgatgtagccacaagacactgatgtagttaaagcggagaaacta

SEQ ID NO: 35900 - DNA, 201 bp, Homo sapiens
tcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcgc

SEQ ID NO: 35901 - DNA, 75 bp, Homo sapiens
  misc_feature 63: r=a or g
aaaattagcctaatatataatagatatattatgaagcaaaacttttatttttgaaaaggcagrataattttcagt

SEQ ID NO: 35902 - DNA, 335 bp, Homo sapiens
aacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaa

SEQ ID NO: 35903 - DNA, 339 bp, Homo sapiens
ttccaccgagaagatggcgtgtgtagtttgctaataattgacctcgtcattaagcaactttcagccctcatctgccaattctgctcctttgtaattatcatatatattttacaatcagtggtaaggctttcatttccttcctaagaataaggtagggcatttctgaagtggttaggacaattctcttgtagcaataggggaaaaaaagaacaaaaaatgtaatatagctacatggagagatgtatgcctctgagctcttttcattttagcagcttgagaaatattgctccacattattgctcagacacacattctttctaaacgaagtttactgccatt

SEQ ID NO: 35904 - DNA, 369 bp, Homo sapiens
ttagctggaactataagcatgcaccaccacttctggataattaaaatatatatatttttgtagagatagggtctcactgtgttaaccagtctggtttcaaactcctggcctcaagtgatcctcccacctctgcctcccaaaagtattggaattacaggcgtgagtcactgtgcctggctatattctggttattgatcctttgtcagatggatactttgtaaatattttttctcattatttgggttgtcttttcattttgttgattgtttcctttgttgtgcacaaactttttttgctgtggttgcctgtgcttttggggtattagtcaacaaatcagaaatccttacccagtccaatgtcctggagaga

SEQ ID NO: 35905 - DNA, 274 bp, Homo sapiens
tagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcc

SEQ ID NO: 35906 - DNA, 318 bp, Homo sapiens
  misc_feature 305: s=g or c
aagtttatcatactagttgatcctctgatcttgaagttcttttggttagaaggaatttggttctgcctccaccctcccccaccttgatctactagcctcccaaagatttagtttgcttcgcatgcctattttagttggaatggcattagtttggtagttttgagcatgtcttttaatttttacttgcataatcctgatttcgatttcctttctttcctcgatgtctgccgcaccttgtttcgcctcctccattcatctcgacgccatggttctgctgctccataacaatgcattatgaacctgcsactcccatatgca

SEQ ID NO: 35907 - DNA, 325 bp, Homo sapiens
  misc_feature 4: r=a or g
  misc_feature 98: k=g or t
  misc_feature 106: k=g or t
  misc_feature 113: k=g or t
  misc_feature 115: s=g or c
  misc_feature 282: w=a or t
  misc_feature 283: n=a, g, c or t
  misc_feature 291: r=a or g
tggrtattttacaagtaacaatattaaaaccctaagtagtatagactatcgagggtgaggtggctgtaaatgtttattagcaatccgcatatcttgtkcttacccktaatttkgsttcataaataaaaggatggaaattgacaaaaaggtgaagtccttagggtttataatggatgattttgtaaaacaggaatcttaagacattctgcctatcaaggctgaatgtacatacacttgagaatatatatatgatatgtatacatattaatataatatataatwngtattaartaagtaaagttttaaaacttgtccaagcgtagag

SEQ ID NO: 35908 - DNA, 357 bp, Homo sapiens
  misc_feature 95: k=g or t
  misc_feature 100: r=a or g
  misc_feature 120: k=g or t
  misc_feature 193: d=a or g or t
  misc_feature 231: k=g or t
atcaagcatttttatacttatctctgccaaatactataaggtgttaaaatttgaaatacgggttaaaaagaatgatttttgcttgtgcaatcttkaatarataatacattgatattggtktaatgaaaacagctgcatcttgaatttaataagattactataacttctaattctgtggctttaggcggtctadtccacaggcagtaaggtttgtttttggaatggactgtkatcatctttgtttcaaagctaaaatatataataagtttcttccaaagttagtttggcctatgatcatgaatgaacaaggacagcttgaaggttggaagccagatgtctcagttataattttgcaat

SEQ ID NO: 35909 - DNA, 159 bp, Homo sapiens
gaaaaacatctcaccaacggcagacagcagaaactaatggttttcaactgttgctgatctaatcaatcatggtgctataatataatcagttctgtgtgattcgtttgttgttctactggaatgcattgtattcccttcttatttttaagccccccgtac

SEQ ID NO: 35910 - DNA, 266 bp, Homo sapiens
  misc_feature 45: m=a or c
  misc_feature 58: m=a or c
  misc_feature 78: m=a or c
  misc_feature 112: y=c or t
  misc_feature 134: y=c or t
  misc_feature 143: m=a or c
atatcatggctttgggaatgtgcatgcctacttgaaaagcctgamacaggaatttgamatgcaagcataatatctggmaaatttgctgcctgccttctacttctcaaatctytcttgtaaaagtttccaatttyctcactgamacctgagttaaaaatcttgatgatcagcctgtttcataagacactccaatcaagttaatcttagcagacatgtgtttctggagcatcacagaaggtatattgctagttacactttgccctcct

SEQ ID NO: 35911 - DNA, 209 bp, Homo sapiens
  misc_feature 109: k=g or t
  misc_feature 112: k=g or t
  misc_feature 114: k=g or t
  misc_feature 154: k=g or t
  misc_feature 163: k=g or t
  misc_feature 166: w=a or t
  misc_feature 171: k=g or t
  misc_feature 185: k=g or t
  misc_feature 194: k=g or t
tacatagcacatgactggggggataaagcatgtataagttgggagagggtaaagaatgtgtgactatgtatacagaaaatagactaaaatgtgcagcaaaatgatatakackgkaatctggtttttgaagtatctactattctggaatattgtkaaacaactkttwgcttktgaaaaaaaaaggkgccttgatkcagttgcgtgacaaa

SEQ ID NO: 35912 - DNA, 63 bp, Homo sapiens
  misc_feature 20: k=g or t
  misc_feature 26: k=g or t
  misc_feature 40: k=g or t
  misc_feature 48: k=g or t
catccaaaaggtgctaggakagatgkttctatcaatgagkgttatgakggctcctatgcagga

SEQ ID NO: 35913 - DNA, 73 bp, Homo sapiens
tggttgaagtttatctttaaaaagagaagctaaattcgtaccttctgttggctgctaaggtatctgttgctga

SEQ ID NO: 35914 - DNA, 336 bp, Homo sapiens
  misc_feature 2: r=a or g
  misc_feature 48: k=g or t
  misc_feature 70: d=a or g or t
  misc_feature 74: k=g or t
  misc_feature 206: k=g or t
  misc_feature 288: n=a, g, c or t
  misc_feature 289: w=a or t
  misc_feature 300: k=g or t
artcaggaatcccttcatcgtgacccccgcatgggcaaaggcttccckggaatctcccacactgtctgcdccckataaaaggcaggcagatgggccagaggagcagagaggctgagaccaacccagaaaccaccacctctcacgccaaagctcacaccttcagcctccaacatgaaggtctccgcagcacttctgtggctgctgckcatagcagctgccttcagcccccaggggctcgctgggccagcttctgtcccaaccacctgctgctttaacgtggccaatagnwagatacccctkcagcgactagagagctacaggagaatcaccagtggc

SEQ ID NO: 35915 - DNA, 54 bp, Homo sapiens
cctttcggccggaaccgccatcttccagcagcagcagtagctatggcagtgaca

SEQ ID NO: 35916 - DNA, 66 bp, Homo sapiens
  misc_feature 25: k=g or t
  misc_feature 34: k=g or t
ctaattaatgaattgtaggaaagtkaaatatatkagaatgaacttgtgaaggcgataactatagga

SEQ ID NO: 35917 - DNA, 66 bp, Homo sapiens
  misc_feature 4: k=g or t
  misc_feature 11: r=a or g
  misc_feature 18: k=g or t
  misc_feature 41: k=g or t
  misc_feature 42: k=g or t
cttkttttcargcggcckggaagatggcgtacattcagackkagcgtgcctaccaaaatcagccga

SEQ ID NO: 35918 - DNA, 404 bp, Homo sapiens
  misc_feature 169: r=a or g
  misc_feature 170: b=c or g or t
  misc_feature 369: d=a or g or t
  misc_feature 370: n=a, g, c or t
cacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcrbctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgdnaggtgtgaataaaatgttgaacccttcccaccac

SEQ ID NO: 35919 - DNA, 145 bp, Homo sapiens
ggcatggtggtgtgtgcctgtagtcccagctactcgggaggctgaggtaggtgaatcgctggaacccgggaggcggaggttgcagtgagccaagattgcgccactgcactccagcgtggcgacagacagaagactccgtctctca

SEQ ID NO: 35920 - DNA, 242 bp, Homo sapiens
agaggtccgggcaaaggtgaggagtggcttcctgatcctacctggaggccgaggatgaccaaatgacctgaaataaaaccctgggtgacctggttggatcaaggcatacgcaagctcccccgggcctgctccacactcggggtgatcacctggcccgcgggcggcccgggcaaggaggaacgtctcgagaaggcagccggctcgccggagtcggttccagcgtgttcgagttacagctgcga

SEQ ID NO: 35921 - DNA, 91 bp, Homo sapiens
ttttttgcgttctctttccctctcccaacatggcggcctcaggtgagcgagcagccgagcgcggccaaggactgggctctgaaacccccct

SEQ ID NO: 35922 - DNA, 311 bp, Homo sapiens
  misc_feature 305: n=a, g, c or t
  misc_feature 306: n=a, g, c or t
gatcacaccactgtactccagcctgggccacagagcaagactctgtctcaaaaaaataaataatactttttaaaataaagtaaaataaagatttatgacaacttcgaatggggctctgtttgttacagggttgcaactgtcgggtcatgatgccagaagctttacctctcattttcctttgcagacacacaaactcgggccacttctaagagtctcttacctgttaggtccaaagaagtcgatgtttccaaacagcttcattcaggaggtccagagaatgatgttacaaaaatcaccaaactganncgaga

SEQ ID NO: 35923 - DNA, 308 bp, Homo sapiens
  misc_feature 127: w=a or t
  misc_feature 265: r=a or g
  misc_feature 306: r=a or g
ctcaattatatgaatagaagtggagagccagaatgctacaaaagaaatcacagctgctagaagtatcctccatagaaacatcaacatgattgtggatcaaaatgattttcactggatatggaaattwgtatgggccatatttattaaaagagttctgtgtggtcacatagagttcctttgggatttcatcccacttttcaggacttaatttgtttgggtttgcttacctaacaagcaacaacaacaacaaaataaatagttccaraatctagtttattacataaatctctatgaatccttgaggcrcc

SEQ ID NO: 35924 - DNA, 204 bp, Homo sapiens
  misc_feature 22: k=g or t
  misc_feature 75: k=g or t
  misc_feature 78: k=g or t
  misc_feature 97: k=g or t
  misc_feature 100: w=a or t
  misc_feature 110: k=g or t
  misc_feature 126: m=a or c
  misc_feature 129: d=a or g or t
  misc_feature 139: m=a or c
  misc_feature 151: n=a, g, c or t
  misc_feature 152: b=c or g or t
  misc_feature 159: r=a or g
  misc_feature 160: s=g or c
  misc_feature 195: w=a or t
taaagacccaataacgattgtkgatgttcctgcacacctccagaacagctgggagagttattatctagaaatttkgakggtgactggtctgcttgcktawatcatgaatkacatcattgggaagamtadaaacagtcgmcttgcacaggcnbggtttarsactcatagggagcttttggagagcaactttacttwagtggggaa

SEQ ID NO: 35925 - DNA, 208 bp, Homo sapiens
  misc_feature 105: s=g or c
  misc_feature 109: r=a or g
  misc_feature 115: w=a or t
  misc_feature 149: m=a or c
  misc_feature 152: w=a or t
  misc_feature 158: m=a or c
  misc_feature 166: w=a or t
  misc_feature 169: y=c or t
  misc_feature 171: w=a or t
  misc_feature 187: w=a or t
  misc_feature 191: d=a or g or t
  misc_feature 195: r=a or g
  misc_feature 196: m=a or c
  misc_feature 202: m=a or c
tgctgctgccactctctccctgtccagaaaaatagaaggagtttgagtccttcccccgccccatttgcagcctcaggaggcgtcagtcccgcagcccattggagsagaracagcwcaacctccggacccagtcccagccctgcctcgcmgtwgcccgmcctcaccwgcycwcaccacggctcctctwctgdaacrmgcttcmccccaa

SEQ ID NO: 35926 - DNA, 144 bp, Homo sapiens
  misc_feature 16: k=g or t
  misc_feature 99: r=a or g
  misc_feature 104: d=a or g or t
tcctcctttcttcttkgctttgtggtctttattgttttttaagatcttgactaactttgaggtctgcttcagttttaggtcttgcttctctgtgtgttratccdctagtcttaatcaaatgccacatctttttaatcatagatt

SEQ ID NO: 35927 - DNA, 118 bp, Homo sapiens
agtcatgtacacggtataagacttggaggaaatgcagggacccttctgttttctcctgcaaagttgaaaaagctgcatgcagttggaagggatcttcagatggtgctggtgactttct

SEQ ID NO: 35928 - DNA, 325 bp, Homo sapiens
  misc_feature 117: n=a, g, c or t
  misc_feature 311: n=a, g, c or t
  misc_feature 312: b=c or g or t
ttatacttttagattttacatttaagtctttaatccatgtcgagttgatttgtgtatatggtgaaaggtagggatccagtctcaatattctacttgtggctagccagttatcccagnacgatttattgaatagggagtcctttccccagtgcttgttgttttcaactttttcaaagattagttggtggtaggtgtgcacctttgtttctgggttttctgacttgttctattggtctatgcatcagtttttgtaccagtaccatgctgttttggttattgtagccttgtagtatagtttgaaatcaggtatnbtgatgcctctggc

SEQ ID NO: 35929 - DNA, 359 bp, Homo sapiens
  misc_feature 315: n=a, g, c or t
  misc_feature 330: w=a or t
tgcacagacttttctaatgttaaggtaatcagacctgctagtctattgctttgtgctttttagggtctaatttaagaaactatccttatcctggagtcaaagatttcttttatacctctttctaaagttatagagttttatacttcacatttaatttccctagaattgattttttttttcatctgaataaccaattgggccagcatcattgaatggtttgttctttccccactgtgttaggccattcttgcattgctatgaagaaatacccaagactgggtaatttttaaattggctcctgattctgcaggctantactggaagcatgawgctggcatctgcttagcttctggggaggc

SEQ ID NO: 35930 - DNA, 61 bp, Homo sapiens
accacccaggctcccttgcctttggctgggtgcaacttccattttaggtgttggatctgag

SEQ ID NO: 35931 - DNA, 322 bp, Homo sapiens
  misc_feature 116: n=a, g, c or t
  misc_feature 117: k=g or t
  misc_feature 118: v=a or c or g
  misc_feature 119: n=a, g, c or t
  misc_feature 254: r=a or g
  misc_feature 255: s=g or c
  misc_feature 296: k=g or t
acatgggtttttctgcacatggactcataaccagcggtgcttcgttaagctccattctggactcagaggaatgctaagcctcttgaggtgacggtctggagctcaccttgtgattnkvngtgttagtgcctctgggacttgatattggtctctgccagagagactgagttgccttctatccatctgttcttgtttccgcttaaatgaacttttcaaaatgtaagccttaccatgtcatgctcctgtgtgcggcrsggtcactctgtgtagaatgtcatcgctgctttattcccctktagcagttacccccattcattctgta

SEQ ID NO: 35932 - DNA, 136 bp, Homo sapiens
  misc_feature 76: k=g or t
  misc_feature 105: w=a or t
  misc_feature 114: s=g or c
  misc_feature 115: w=a or t
  misc_feature 116: y=c or t
  misc_feature 123: r=a or g
  misc_feature 124: m=a or c
  misc_feature 135: k=g or t
  misc_feature 136: n=a, g, c or t
gcgaacggcctgccggccgacggctcccacatcaggacgagaaggagccctcgagttaccgtgggagctgtgggakctgccctgtgactcttaggaagatgccgwacccttggswyccgaggrmcgtggaccggkn

SEQ ID NO: 35933 - DNA, 177 bp, Homo sapiens
  misc_feature 118: m=a or c
  misc_feature 130: k=g or t
  misc_feature 144: r=a or g
  misc_feature 145: d=a or g or t
  misc_feature 171: s=g or c
  misc_feature 172: m=a or c
  misc_feature 174: b=c or g or t
  misc_feature 175: r=a or g
aagggacaggggagatgtaataatagggtcaacaaatcaggccccttgtggggctgagaattgttgcttcaggatagctagagaaagagctgggaaggtggtgtggtgggacgctggmagttggtgtgtkctggtttcgtgggrdagtggaagtcactggagtgatggggsmgbrat

SEQ ID NO: 35934 - DNA, 89 bp, Homo sapiens
  misc_feature 81: m=a or c
atcacttccttcagagtttgaaaaaaaaaaatctgggaagtagaggtgttgtgctgagcggcgctcggcgaactgtgtggmccgtctgc

SEQ ID NO: 35935 - DNA, 132 bp, Homo sapiens
  misc_feature 103: m=a or c
gatccacttttttactcccatgtaagagtgagaacgtgcaatatttgtctttctgtgcctggcttatttaactgaatgtcctctccaggttgctgcagatgamaggatttcattcttttttatggctgaaca

SEQ ID NO: 35936 - DNA, 245 bp, Homo sapiens
tcagttctttacaaccgcatggtaattaagcttgtattcacaagacttcatgccaaattcactttttagcattatatctaacaaatcaagagaatccttaatattgctgcagttgagtttaaaagtgggttaaaagtggccatttgacaatctcatatttgttttctctacatggcttatatgatgtgtgccttctagggaatgaagggaagtggtgatagagatcagcagcagcaggggctgca

SEQ ID NO: 35937 - DNA, 347 bp, Homo sapiens
  misc_feature 311: r=a or g
tcagaaattgcggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctgataaagacatacctgagaccaggaagaaaaagaggtttaattggacttacagttccacatractggggaggctcagaatcatggtgggaggcaaaaa

SEQ ID NO: 35938 - DNA, 281 bp, Homo sapiens
  misc_feature 43: s=g or c
  misc_feature 123: s=g or c
  misc_feature 124: v=a or c or g
  misc_feature 155: w=a or t
  misc_feature 173: w=a or t
  misc_feature 195: w=a or t
  misc_feature 200: m=a or c
cacaaaattaattttccaagtaggatcctgaagggagcgcgastggcttctctgtcctttttgtcttcctctaaccacgctttcacctctggaccgcattgatctggagcacattgatcccgsvcggcctttgtggtcttggttagaggagtgawttttctgttttcctctgwctttttcatcaaatcgttccgwgcctmtgccttgcaagctgaagcgtgtgagacggtagtcgcagttgtattttgctttttgatggcgttgctcatggggaggtgata

SEQ ID NO: 35939 - DNA, 101 bp, Homo sapiens
ttgtttgggcccaggagacagattgcagtgagctatgatggcaccactgcatggcagcctgggtgacaaagggagactcagtctcaaaaaaaaaaaaaaaa

SEQ ID NO: 35940 - DNA, 321 bp, Homo sapiens
  misc_feature 298: n=a, g, c or t
  misc_feature 318: b=c or g or t
  misc_feature 319: n=a, g, c or t
gggctttctttcacagcactgggtgaaggcagtctacttcaggagaagcaatgtgatttaccaagactaacaaccggagaaaactgtatcactcagaatctgagtggtggcagagactataactgccttgttcgctgctatatctgcaacgctaaaagtatactgtctgccacatacaactggagagcctgtatcactcagaatctgagaggcagctcctgacttgaaaatgatcattgtgtgtaatgtagatcgagtcttgctctgtcacccaggctggagtgcagtggtgtgatgngcagcctcaaaatcccggabnat

SEQ ID NO: 35941 - DNA, 324 bp, Homo sapiens
  misc_feature 106: w=a or t
  misc_feature 112: s=g or c
  misc_feature 113: m=a or c
  misc_feature 128: m=a or c
  misc_feature 135: m=a or c
  misc_feature 209: s=g or c
  misc_feature 298: n=a, g, c or t
  misc_feature 301: m=a or c
aaccaatcaattacttagaactaggcaaagatgaaagtatagccaactattcttggctatatatatatattcaagtgggccgggcgtgatggctcacacctgtaawtccagsmactttgggaggtcgmggtaggmagatcaccgagcccaagagttcaagacaatcctggccaacggcgaaactctgtctctacaaaaaatatacaggsgtgttagcatgtgcctgtaatcccagcttcttgggaagctgaggcacaagaattgcctgaacccaggaggtggaggttgcagtgagctnggmtccgcgccatttgcactccagcc

SEQ ID NO: 35942 - DNA, 416 bp, Homo sapiens
  misc_feature 378: h=a or c or t
  misc_feature 379: r=a or g
catgttctgtgtcatcgtcaccctggatcatcccacagtgtgaagggatctgtctttcaaggtgcttcatgagtgatgctatgtgtgtgaaggaacagaggcaaatcgcaattccctgttgatctggtgctttgcacgactcagggcgtgtgcaccttgcagccaccccctctccttgccctgggcatatcatgtacagaaaaacagaccttgactggctgcccaagagcctctgtttttttcttcccagtggcctgctgcctgcttaagagacagataccccaactccgaaggcaagcccctcacctgccattgccaacacctatgccctctgagtgctggtgaagagttgttcagttttgctactcagctggcathraagcttgaagcctctgtgccctctgaggctattgcct

SEQ ID NO: 35943 - DNA, 239 bp, Homo sapiens
taaagtttaagaagcatggtgacaggaaaactggcttaggttgagattagggtgcactgaagaagtgtctcttttgttgggggcattgtcactggctggtgatctctagcttagccagcagaactccgtaactcataccacttctttgtctttctcagcaatcatgttccacggaagagccccaagtatttggctttgtttaaaaattctgtgaggtaagaaaaaacttattggcaagc

SEQ ID NO: 35944 - DNA, 197 bp, Homo sapiens
tcagacaagaaactcagaccgggcagtcccctattgaggctctgagctaatatcctcccaaaatagacatgaaccacaaggagaattttttaaaagccaaatgataaacaccactttctttccggatgcggggctggagcgctcattccctttcccaggaagctcagccttatccccatgaagagctggggggggta

SEQ ID NO: 35945 - DNA, 197 bp, Homo sapiens
  misc_feature 109: y=c or t
  misc_feature 113: w=a or t
  misc_feature 114: r=a or g
  misc_feature 117: w=a or t
ttttctttcttggtagtagttgagaggaaggagggtaggcgcaggacagagaggagagggaaaacagaaaaagaattgtgtgccactatgtctgaatatatcttctacytgtwrgawaattaacatccaagttgcccttttgcctttttatttccgtttttggacacctctttttatcatccagccaactggaaact

SEQ ID NO: 35946 - DNA, 282 bp, Homo sapiens
  misc_feature 20: n=a, g, c or t
  misc_feature 21: y=c or t
  misc_feature 117: m=a or c
  misc_feature 118: n=a, g, c or t
  misc_feature 132: m=a or c
ctcctccctccttccttccnycccttcctccctctctccctccctcccagctcctgcaccaggaaacggcccggatcccggcagcggcctgacccggctccacgcctgggcccaggmngatgaaaggccccmagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgt

SEQ ID NO: 35947 - DNA, 147 bp, Homo sapiens
  misc_feature 96: y=c or t
aatagccttaaaatatgaaacaaatattagcatttgttaatttgagatgttatgttcacagatattggtaagattatcatttttaatttatgtgtyttaaatttcctttttaaaaagatttcccctagaaacacgtaagggagagta

SEQ ID NO: 35948 - DNA, 181 bp, Homo sapiens
  misc_feature 120: w=a or t
catattgtatgattccttttatctgaaatgtctagaataggcaaatccatagagaaagaagattaattgttacctaggatggaaaggttggaaggaatggggaatgattgctaatggtawgaggttttgtgggggatgatgaaagtgttctaaagttgattctggtaataattgcacaacc

SEQ ID NO: 35949 - DNA, 68 bp, Homo sapiens
cattgtgaaatgagtaccaaaatcaacctgacatatccatcacctcacctagttaccatttttttttt

SEQ ID NO: 35950 - DNA, 237 bp, Homo sapiens
  misc_feature 16: r=a or g
  misc_feature 17: r=a or g
gaaaagaaaaagagarrattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctct

SEQ ID NO: 35951 - DNA, 161 bp, Homo sapiens
  misc_feature 115: w=a or t
  misc_feature 121: y=c or t
  misc_feature 155: k=g or t
caaccttgctaaactcatgtataatagatgttttgtagattacttaggattttctatatagatgattatgttgtttgtgaataaagacagtattgcttcttcctttccactctgwatgccyttttatttcattttcttgccttattgctctggckaggcga

SEQ ID NO: 35952 - DNA, 181 bp, Homo sapiens
tatcatttatggcattgtcccttttgtttctagactaggttgtggttttgcctaagttgtgacccccccccaatatcaattgcattgaatgaaatatgatatatttaccgtttgtgattttccatactcaacacctgtgccaactctcctccaagtagtattcccacttttatgaccccct

SEQ ID NO: 35953 - DNA, 461 bp, Homo sapiens
  misc_feature 147: m=a or c
  misc_feature 148: m=a or c
  misc_feature 184: r=a or g
  misc_feature 282: k=g or t
  misc_feature 359: s=g or c
  misc_feature 400: r=a or g
  misc_feature 401: d=a or g or t
cttttactctgtttataatatcaagtattttcttaaagatatagatattaaaccttgtgctcatgcaacttagagtaacatatacagacaaatgattgcatgaggccatgtttatatgtgtgactaataaggcttgtcatgatttammataatccaggtatgtcatttctgaagagaatagtcrtcaaatttatatctcgaagattttaattaaggaattgcttattgttgagcttagcaaattaataacactatttctgtcactaattattttgaggcctkttagtactaaaattttaacctgtgttctaagtagaaactgatttaacccaagtaatgcagctttgattgatttcagsattcgttgctttgctatttttacaaaaacagcattgattgrdgcaagtcttggttttactaaggtagggtagcatttgctattggtaaaagagaataaatac

SEQ ID NO: 35954 - DNA, 302 bp, Homo sapiens
tgaccttgtagcagttatctttgttaaactccttcatttcttattttaaataattaattaattaatttagagacagggtctcactatgtcacccaggctgtagtgcagtggtgcaatcatggctcactgtagccttgacctcccaggctcaagcaatcttcctacctcagcctctcaggcagctgggactacagacccacagcactacgcctgacttatgattttattttttgtggagacagggtcttactatgttgtctgggcttgtcttaaactcttgggccttagcctaccaactagct

SEQ ID NO: 35955 - DNA, 194 bp, Homo sapiens
  misc_feature 139: y=c or t
  misc_feature 140: k=g or t
  misc_feature 145: r=a or g
tactcataaaatatactttaattgggttcaaagagagttaatttaaaatataaaaatcaaagagagtgccagttgatgagtttccactcctttctgtaaatagcattaactgttctagaaacttcgaaatgttaaatcykgatartgcaggacagttaattataacttaaaatatttatagacacaggaagccg

SEQ ID NO: 35956 - DNA, 340 bp, Homo sapiens
  misc_feature 4: d=a or g or t
  misc_feature 5: s=g or c
  misc_feature 6: k=g or t
  misc_feature 70: r=a or g
  misc_feature 248: s=g or c
tatdsktaactttttcttttttgagacagagttttgttcttgttgcccaggctggagtgcagtggtgcgrtcttggctcactgcaacctccgcttcccgggttcgggtgattctcctgcctcagcctcctgagtagctgggattacgggtgcccaccaccacgcctggctagtttttgtatttttggtagagacggggtttcaccgtgtcggccaggctggtcttgaactcctgacctcaggtggtcsacccaccttggcctcccagagtgctgggattacaggcctaagccaccgcgcaggcctatacttaacttttcaaagttcataaactactgcca

SEQ ID NO: 35957 - DNA, 350 bp, Homo sapiens
aattagttacagagaggattgactcttgatgctcagtggtcagcaagtactttagtatctaaagtgggccttgcaaacaagaagtcatcttgtcacattaggtttgtattctctgtaataatatgtgtactggttttagtataaaagtatttaagttgctttactgttgaatacaattgacgttctacgaaaatgtgtttattgtgggccctcatttgtaccagccctctgtaaatatgcatatcagtctcataccccaactggagaagccggggatagggtaggcatcaaacctgctggtgctgagaaccacccctccatgctttcctgctggctctgccaaaccaccc

SEQ ID NO: 35958 - DNA, 246 bp, Homo sapiens
  misc_feature 137: m=a or c
  misc_feature 143: r=a or g
  misc_feature 153: w=a or t
  misc_feature 170: b=c or g or t
ctgatacttggttggtctagtaattttcttattaagtgctagacactatgcacattatgttgttgggtgtgtaggttttgtgcatttctttagaatatttggctttctttaggcagataatttaaacaacatgtgamtccagrtgatcccttwaaggcttgtttttaagbattgcttaggctagtctggggcatccttcatgccagtgataatttggttttactaataatttacctaccccaactc

SEQ ID NO: 35959 - DNA, 340 bp, Homo sapiens
tattttgaaattaattctgaagttcctaaaagtattacatcctttggacatgacagtgagtaagaacagacctaaatatcctttagtccttcgttaccaacatattcaaactatattcagctgatggccaattaagaaattctttgatagattctgatttgttttacttttagcaaacagatattttacaaagattttaaaagctttaattttcttttttattgtctcatgtaagagtcatgtaagccccttaactcacaattaaatttttgtaagggatgttggttgagttttttctctccttttaaaaatgtttcatgtatttttctaagtctacaac

SEQ ID NO: 35960 - DNA, 151 bp, Homo sapiens
  misc_feature 133: w=a or t
taatagttataaaaaaataaaattgccttcttaaacattttcaattgtacggtctagtgatgttaagtatatttacattatattgcaatgggtgtctagatttattttatcttgtaaaatacaatacccaatwaaaaattaaactgcccat

SEQ ID NO: 35961 - DNA, 331 bp, Homo sapiens
ctcaaaggctatctggatccagctgtaaccaggaagaaattcagacggcgtgttcaagaatctacacaagtgctaagagaactggaaatttctttaagaactaaccacattggatgggtcagagaatttctgaatgaagaaaacaaaggtcttgatgttctagtggaatatctctaatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctg

SEQ ID NO: 35962 - DNA, 113 bp, Homo sapiens
  misc_feature 50: w=a or t
  misc_feature 85: d=a or g or t
tttctgtgttgtttttctgttttcacttccattgattttttgtttttatwatttcttctccttgctttggatataatttactctdgttttttagtttcttaaggtagaagtca

SEQ ID NO: 35963 - DNA, 152 bp, Homo sapiens
  misc_feature 113: s=g or c
  misc_feature 114: r=a or g
  misc_feature 120: r=a or g
  misc_feature 121: h=a or c or t
  misc_feature 146: m=a or c
  misc_feature 149: m=a or c
agagagagggagcttgtcttgtccctgagcagcgctctcagggcagaggtgaggcaccgggacatgaagttggaggacaagttcccaagcagggcttcctcgggctccccctsrcgacgrhaatttgacacttggatctccaggamgamcac

SEQ ID NO: 35964 - DNA, 185 bp, Homo sapiens
  misc_feature 128: w=a or t
catccccaggagcactgtatctttgcattttactcttttggtttccttgatactccactgcttaaagaaaggcatctccccaagcttctcttagatattttgttcttacctacatactttcttaccawtcccaggcttcaacaatcatcttgctgtggttaactcctgaaaattacatctgcaac

SEQ ID NO: 35965 - DNA, 418 bp, Homo sapiens
  misc_feature 16: d=a or g or t
  misc_feature 17: d=a or g or t
  misc_feature 199: d=a or g or t
  misc_feature 200: b=c or g or t
cattcatttcattccddttataacccctatgcatgggataaaaaatactatcacatgtttaatttttctagttggttatttgagtcttgaaatgtccagtttggcagataatcttgaactgtccccctgggggccatctgctatgccctctgccttgaatttttcaggaactgaaggggttccttaagtccaaggaagdbagtcctcttttataaatcaggaggggacaaaggacattctaatcattcttttgttaccagtgattctgttgctgcattgttgccactgagactggtcctgcagtctggaaatgattgacctttgctacaaggatgctcttactgattgagatccctcagccttcatggtgatccataggtagacttcaaagttaggactttttttcagttcacataca

SEQ ID NO: 35966 - DNA, 340 bp, Homo sapiens
  misc_feature 182: b=c or g or t
  misc_feature 183: m=a or c
  misc_feature 234: d=a or g or t
ctcaagaactctgtttaaaagccatgcccagcctctgggaggcaggataacatgcattttgtggaccaaaaagcctgggtttaatccagactaccatcatttacttcctgtgcaatattgggcaagagactaagcccgatgccaccctcactctgttaagaagaagaactggtgtttaaacbmaagacatctattttagattccccactcttcaccactatcctgagcaaaggdccaatggatctaaattatttgggtagcacagtcactggctgctcataacataacagcaatgaagatgattatcttttgatgagattatgaagttgatggtgatgat

SEQ ID NO: 35967 - DNA, 106 bp, Homo sapiens
  misc_feature 16: v=a or c or g
  misc_feature 42: y=c or t
  misc_feature 43: k=g or t
attgctgagatgattvctgctttccggctccccgacacccgykgttctttagatccgctcagcggcgctttttcctgtgccacgtgcccagatctgagcgaggctt

SEQ ID NO: 35968 - DNA, 173 bp, Homo sapiens
  misc_feature 16: s=g or c
  misc_feature 48: d=a or g or t
  misc_feature 81: r=a or g
  misc_feature 82: r=a or g
  misc_feature 90: r=a or g
  misc_feature 93: m=a or c
  misc_feature 100: v=a or c or g
  misc_feature 109: r=a or g
  misc_feature 110: m=a or c
  misc_feature 119: v=a or c or g
  misc_feature 125: d=a or g or t
  misc_feature 155: m=a or c
  misc_feature 159: r=a or g
  misc_feature 162: m=a or c
acacactcacatacastcacacacatagagaccaacagatagacagcdacctaaagcctgaaagactgacagcaacacagrraaaaagaracmggcagavagagagacrmagacagaavtagaadcagactaacacacagagtcaaaaatacagmgacrgamagacagggagc

SEQ ID NO: 35969 - DNA, 87 bp, Homo sapiens
aatctgtttctctttctaagctttttttctttcttcccactttgagagcccccagtggtattagtaattttggagagcccccagatg

SEQ ID NO: 35970 - DNA, 180 bp, Homo sapiens
cagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccac

SEQ ID NO: 35971 - DNA, 152 bp, Homo sapiens
  misc_feature 129: m=a or c
accttggggaccttggacacggagctggttatgtcacatctggctctcagagctggggcagcgtctaggaggcctgatgtagaaagcactcagctaagccctagttaccggcacacgggcaccagcgcmccctctcagcaaactccacgact

SEQ ID NO: 35972 - DNA, 261 bp, Homo sapiens
  misc_feature 122: k=g or t
  misc_feature 166: d=a or g or t
cttagaagttactaatatacaggcatccatgtatttttctttataacttctgtagctctttcttgaatactggttagttagcaaaaccccatctgatccttgatggcacagagctgtgcttkaagttctataactaataatttttgttctaagtgtggatgccaadaaatggacatttcatatggtacttatactacataatagtctttaatttgatattagggtaatttgtaacacatcatttagactataaagtaggat

SEQ ID NO: 35973 - DNA, 388 bp, Homo sapiens
  misc_feature 16: r=a or g
  misc_feature 17: k=g or t
  misc_feature 58: r=a or g
  misc_feature 65: k=g or t
  misc_feature 98: w=a or t
  misc_feature 118: r=a or g
  misc_feature 129: y=c or t
  misc_feature 230: h=a or c or t
  misc_feature 258: w=a or t
  misc_feature 335: m=a or c
  misc_feature 336: m=a or c
  misc_feature 354: m=a or c
aaaaaaggtaatttarkaaggaaataagataaataagcaaaattttaaaagggcataratactakaaaaggggagtatggattattttaaagcaatgwaaattatattcattgggagraccattataaycaagtaaacatatatgagaactaataggtaaccacctaaaacataagaatttaaaaagtagaaactttttgtaaggaaaatcacattcacagtagcaagahtaacacaacatatttgagattttatttwaaaagaaatgttcaggccaggcattttggctcatgcccgtagttccaatctacttgggaggctgaggcaggaggatmmcttgagcccaagagttamaaggcttcataagctgtgattgtgcaattgcatt

SEQ ID NO: 35974 - DNA, 389 bp, Homo sapiens
  misc_feature 109: y=c or t
  misc_feature 292: n=a, g, c or t
  misc_feature 293: n=a, g, c or t
  misc_feature 294: n=a, g, c or t
tatggtatgtttcattatcaaaaccatctatagcctccaaaggatgacaggtgttatagtgtgagtggcgtagagggtgttgagatagaggaatgaaaagagaagagaycgtttccctttccactcaccattcatagaggaactaagttttaccttctagggaattccctgtaattcccagggacgccttgtccttgcggttcccaggcaggatggtaggaggagctaagtgggagggaattaatatttcttgagtgtcggctggtaagttggttgctttacctccactttnnnagagacagggtctctccgtgtcacccaagatggagtgcagtggtgtgatcatagcttactgcaaccttgaactcctacctacactattttactta

SEQ ID NO: 35975 - DNA, 326 bp, Homo sapiens
  misc_feature 186: d=a or g or t
agaattagaaatttagtgctatacacatactttagtgcctaaagtcttcccagcagaattgagttattcagtgggaaaaagatatttgccttaaatctgtttcattaaactaatactgattcctgccacccctccttataggatatttgggatataccagtggcctttccttgttgtgtatggtgdtctttctgattgtggtgggtatgattttttttttagaaaaaattttttataagccctgccatgtcacttagtttaacacatgcaaaataatatatttttaggtcatttgcaagaaatttcaaggttccgtgtcctgtgga

SEQ ID NO: 35976 - DNA, 359 bp, Homo sapiens
  misc_feature 266: s=g or c
  misc_feature 302: n=a, g, c or t
  misc_feature 331: s=g or c
  misc_feature 342: m=a or c
gcgtacccaggcgtcctcggtacccacgaaacggatccaaagagtctcaacactaatgtaacatcccaccctgacccatctttgccctctgagaaaagcggcccgaaaatgagttgagttattcatccccaccgcggagtcagggacaaggagcagttgagtggccgaggagtgagagagaatcgaatccactcgggtcctccaagctgttggttacccacttgggctttcacagcaaagctgccaaatcccagaattgaggcctsgtgaaaagcgcgctgagacttgggtaggaggcccgntgggacccgcgaagctttctctcccagcscgatgcagcamgttcattaagcggctgt

SEQ ID NO: 35977 - DNA, 222 bp, Homo sapiens
aagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacact

SEQ ID NO: 35978 - DNA, 385 bp, Homo sapiens
  misc_feature 197: n=a, g, c or t
tatcccatttaacctgattattttccaggtatgcttctcagagtgagaccctattcccatcaggttccatagtctgaaatcctcagccttccctctgacactactctttccccttatttgcaatctaaaaaaaattgattttctgtctctcagatccatccatttcactttcatctccatttccaccaccatagccnaagttaccatttataattttctggacgaatgttgaataatttccattttgacattgccgtatggttaatcccttgaatcctcttcccaccatggctagagttctttacaaactgcaagatctgacttctatcccaattctgaccctttatcctccactgttaaatccaatcatggcttcctgttgctc

SEQ ID NO: 35979 - DNA, 308 bp, Homo sapiens
  misc_feature 308: m=a or c
catatcagagtgttcaaattagtgataatctaactttttgcacgtaagagtcaagtctggaataacaaaaacatttagagtctgcatttggattgaaattctgaaattactgaatttcagggagaaaatgtatacactcttacaatttaaattacgtactctcttgaatgccagtgagaaaagttttcacagctttttaactgggcatattggagttggcaacatagtaacagctttctaattgttcatgtcggtaattaaattattggctttattttgaagctggcagcataaatctgggacctggm

SEQ ID NO: 35980 - DNA, 228 bp, Homo sapiens
ttgtctaatatcttttctcctcattttctccatcactgccctcttttgtgttaagctgactttatttttttgtagcaaaacatttgcttcccttcttatttctttttgtgtattttaaaaaaaattattttctggctgggcatggtacctcactcataatcccaacactttttaggaggctgaggtaggaggatcacctgagcccaggagtctgagatcagtctggac

SEQ ID NO: 35981 - DNA, 97 bp, Homo sapiens
  misc_feature 16: k=g or t
  misc_feature 17: k=g or t
  misc_feature 61: r=a or g
  misc_feature 64: y=c or t
  misc_feature 65: k=g or t
caaaataaattggcckkgcgtggtggtgcatgcctgtgatcccagctgctcgggaggctgrggykggagggtcgcttgaacccgggaggcagaggtt

SEQ ID NO: 35982 - DNA, 86 bp, Homo sapiens
  misc_feature 57: r=a or g
  misc_feature 58: w=a or t
  misc_feature 73: k=g or t
  misc_feature 84: r=a or g
  misc_feature 85: r=a or g
  misc_feature 86: s=g or c
aagcacaaaggaatgaacttattaatatttttgaaaaatgcactgggaaaaagttgrwggtcaataacagttkaaaacagcccrrs

SEQ ID NO: 35983 - DNA, 341 bp, Homo sapiens
  misc_feature 50: k=g or t
  misc_feature 64: w=a or t
  misc_feature 93: s=g or c
  misc_feature 94: r=a or g
  misc_feature 102: k=g or t
  misc_feature 108: d=a or g or t
  misc_feature 115: k=g or t
  misc_feature 122: k=g or t
  misc_feature 168: w=a or t
  misc_feature 169: y=c or t
  misc_feature 277: r=a or g
  misc_feature 278: d=a or g or t
  misc_feature 279: r=a or g
  misc_feature 283: k=g or t
cagaatacaatccatgtgggaagtatatggtaaaacttcacctcaatggkgtcccaagaaaggwgataattgatgaccagttacctgttgatsrcaagggakaattgdcttctgktcttatkccaacaacaaaagtgaattatgggtttctctcatagaaaaagcatwyatgaaagtcatgggaggatatgattttccaggatccaactccaatattgatcttcatgcactgactggctggataccagaaagaattgctatgcattcagatagccardrcttkcagtaaggataattctttcagaatgctttatcaaagatttcacaaaggagatgtcctc

SEQ ID NO: 35984 - DNA, 358 bp, Homo sapiens
  misc_feature 17: s=g or c
  misc_feature 32: w=a or t
  misc_feature 134: m=a or c
  misc_feature 142: h=a or c or t
  misc_feature 146: d=a or g or t
  misc_feature 150: w=a or t
  misc_feature 151: v=a or c or g
  misc_feature 158: r=a or g
  misc_feature 323: y=c or t
actatcactcccccatstcagatatccccccwaatcctggataccatttgttgaaagatgttattactctagctgaacttacaagagactttagaccagggatctaaattacagtggccttagtgaccttgtcmttatacthcttdaggwvcaagctrgagaagccactgggacttagagcctttaaaaggagattaactgtcccaaaaggatctttgctactgaccagcagacacttcttccttcagtagcctttcatactgtgttgagtaacaccctagggtgtccattaaagttttgagttttacctagagcccagagcyatgaatcaggattctgtctacatgattcgtgtttt

SEQ ID NO: 35985 - DNA, 139 bp, Homo sapiens
  misc_feature 133: s=g or c
  misc_feature 136: k=g or t
attttctagataaggcactgggggctccgcgaggggatgtggcggactggagcccagctgcactcctgacgggactgaatgcggggctgagggaggcaacaggaagaatgagtattttctttactggaagggscakcag

SEQ ID NO: 35986 - DNA, 180 bp, Homo sapiens
  misc_feature 130: w=a or t
  misc_feature 139: n=a, g, c or t
  misc_feature 144: m=a or c
  misc_feature 145: h=a or c or t
  misc_feature 163: y=c or t
caatcactgttgaactataaaagagcaatttcagaatgtgatgaggtatgagatagtttccaagaggatagggagtcaataaatgaagaagaaatggaaacaggcagttttccgctgctaaaaaaaagawaaagaaagnaagamhaaggattccaaagataaytcagaggcacacacttc

SEQ ID NO: 35987 - DNA, 312 bp, Homo sapiens
  misc_feature 153: v=a or c or g
  misc_feature 154: v=a or c or g
  misc_feature 160: w=a or t
tccatatttatacttcactcttatgtataactccgtaagtaacagagcatagtgttttccatattttaaaactttatataataatgtaaccctatatgtatccttatgcaacttgatttaatttttgaccatttttttaaaaataaaaaattvvgttttwacccatgttaaaagtattcagttcagtggtatcatgtacattcatattatatgcaactattaccaccatccatctccagagctgtttcatctccccattgtttcccccaaactatgaaacttcatacccattaaatagtagcctccctctac

SEQ ID NO: 35988 - DNA, 266 bp, Homo sapiens
  misc_feature 145: m=a or c
aagactgtgggcatggtggctggagatgaggagacctatgaggtatttgctgacctgtttgaccctgtgatccaagagcgacacaatggatatgacccccggacaatgaagcacaccacggatctagatgccagtaaaatcagamctggccgaagcatccgaaggactcagtctgcctccagcttgcactcgagcagagcgacgagaggtggaacgtgttgtggtggatgcactgagtggcctgaagggtgacctggctggacgtc

SEQ ID NO: 35989 - DNA, 420 bp, Homo sapiens
  misc_feature 340: h=a or c or t
  misc_feature 348: w=a or t
  misc_feature 379: r=a or g
  misc_feature 400: n=a, g, c or t
caaagttaacagctatcgggagcaggactgactaatgaaattctaatctgggttgttatgtgaagttgggaagatagcaaatgaagcgggtttgcctacacacgtaaaaggttttgtaatgagatctttggagtagttagcaggttttctacttctgttaggtggctccctgagcaggcacaggttccaagctgatactgtcactaactaatgcacttgcagtaggacataagtgaaaatgttacagacatttggctattaaatgcctcagactatgtttggacaaattaaatacagagattgctcccccacccccaaccactatgtatcactttgagghgtgagacwggttctaaagctgtagggggtttgaacatcrataaaaacatttaaacatacngaccctttgtacttttttct

SEQ ID NO: 35990 - DNA, 103 bp, Homo sapiens
cactgtttgttaggccttaaacaacattcactgtggtggtatcaggcacactgctatgtgcatcaattatttttttgctttccaaacagaatctctggggagc

SEQ ID NO: 35991 - DNA, 368 bp, Homo sapiens
  misc_feature 126: d=a or g or t
  misc_feature 140: d=a or g or t
  misc_feature 142: w=a or t
  misc_feature 143: w=a or t
  misc_feature 197: n=a, g, c or t
  misc_feature 298: m=a or c
  misc_feature 310: n=a, g, c or t
  misc_feature 318: n=a, g, c or t
caagaaggtgttaaacaagatttttagttttaatgaaatattagatacagtaactaacaagtcattaaatgtttagtgtgttgactttgtattcttttatcatttaagataaagttttgacttttdataaagtacagatdcwwgtagatagcatatagaaagtgttaatacttctatgttgtcatgataaggactantatccccaatgttttttttataagtattaagaaattacatgttgagtgccagatgtcaaagtttaatcattgtcactcattttgagcactctagatatgamgattttaatacngtattaanatactttcatagattttaggtaacttactatcatgtagtgaaatttttaa

SEQ ID NO: 35992 - DNA, 237 bp, Homo sapiens
ctgctttcaatcgtgtgctgtgtctccttccagatccttttgtgtttatgtaaacatgttgatttttatattgtcctacatgtttatattgtcctgtagtctatactttcattcacttgaaaatttatccaagacttttcaggatagcacacacagatccttctcattttttccaggtatccagtatttcagtgtgtgaatgtaccataatttctcttaaaaccaatcccccggcgg

SEQ ID NO: 35993 - DNA, 226 bp, Homo sapiens
  misc_feature 136: s=g or c
  misc_feature 137: n=a, g, c or t
  misc_feature 180: w=a or t
aagctcagggtcaagttctgagcaaaaagtgtcaaggagcctttttgcaacctcctataatattgaaacagattctgtgccctttaaaggagataataactaacatctggggagcgctttacaatttagaaaaggsntttcacacacaggcctgtttcatcttcacaacaatcttatagwacagatatattgttcccatttcccaaataatgaaacggaagcgccc

SEQ ID NO: 35994 - DNA, 266 bp, Homo sapiens
ttacagaattagtatgaaaatttttactatttataactacttgtatgaaacctaatacagaaataaattatgtcaaacacaatcctactttcaaatttttaagtcctttcaactgacacattttaaaaaggaaaatactacaaattttccactttataaatgtgtgccgttttgatcacttgaaaatgtatgaaagattgcatttggaggaaaaaaggttgtgctaataaaaaatgtctcaagaccaatgttaaagtggagctata

SEQ ID NO: 35995 - DNA, 72 bp, Homo sapiens
ttttgttctttgttatgccatttaaaagttattcttccatcatgatgtgattttataattcttttttttttt

SEQ ID NO: 35996 - DNA, 328 bp, Homo sapiens
  misc_feature 290: r=a or g
cacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccrggtcttatccattccccgttaatttgcaccacccccga

SEQ ID NO: 35997 - DNA, 272 bp, Homo sapiens
ggcaacccgctccggtcaccttccacgctgtgaaagctttgttcttttgctctttgcaataaatcttgctactgctcagtctttgggtccacgctgcttttatgagctgtaacactcactggaaagtctgcagcttcattcctgaagccagcaagactgcgagcccccgggggaggaatgaacaactccagagacgccactttaagagctgtaacactcaccgtgaaggtctgcagcttcactcctgagccagcgagaccacgaacccaccc

SEQ ID NO: 35998 - DNA, 135 bp, Homo sapiens
ggccgggcgcggtggctcacgcctgtaatcccagctctcagggaggctaagaggcgggaggatagcttgagcccaggagttcgagacctgcctgggcaatatagcgagacccccgttctccagaaaaaggaaaaa

SEQ ID NO: 35999 - DNA, 199 bp, Homo sapiens
  misc_feature 162: n=a, g, c or t
attttgcctctggcaggaaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggncagcgcgagggtttctggccatcgaccctcacctccc

SEQ ID NO: 36000 - DNA, 210 bp, Homo sapiens
  misc_feature 121: w=a or t
  misc_feature 139: d=a or g or t
catatatgtacatagtattgtttgctttttatgttgaccatcagcctcgtgttgagccttaaagaagtagctaaggaactttacatcctaacagtataatccagctcagtatttttgtttwgttttttgtgtgtttgtdttgttttacccagaaataagataactccatctcgccccttccctttcatctgaaagaagatacccccctct

SEQ ID NO: 36001 - DNA, 172 bp, Homo sapiens
  misc_feature 139: v=a or c or g
  misc_feature 141: w=a or t
  misc_feature 156: r=a or g
gaaaattttctctgtagtgtggatctctctagaagtcacaagggagaccacttccttcaaagagaggagaagaaaaggatacagaggatcagctactcaacacccacttttgatgggctgaagaaggagagtgaacagvtwaaaggaggactccarggttaagaggcaccca

SEQ ID NO: 36002 - DNA, 341 bp, Homo sapiens
  misc_feature 141: w=a or t
  misc_feature 148: s=g or c
  misc_feature 149: m=a or c
  misc_feature 150: m=a or c
  misc_feature 152: w=a or t
  misc_feature 194: w=a or t
  misc_feature 195: v=a or c or g
  misc_feature 233: k=g or t
agagaacctaaaaattaaagatcagactcagggtctgacccattgagtgacactgaaagcccatggctttcaagaaatgttacttccttactcccaaatccaaacctgctctaagggagtgataactgactcttaattggwtggtagsmmcwatattagatattgctgagtacacattttcactctttccactwvactgtgattttcattttataaaaactgtgtaatgattktgttgttgttgatcatttgttttccccaaagtgaaatgcagaacccaggctagtagcagataatagcagagccactgtggttgaaatggggagaggggttcagggcct

SEQ ID NO: 36003 - DNA, 116 bp, Homo sapiens
  misc_feature 22: m=a or c
  misc_feature 40: s=g or c
  misc_feature 43: n=a, g, c or t
aacgcggagagagacgaagggmgtgggagaccagcgacasgangcgccagggcaccgcaggcacactggatgcccagtccgccggcccagccgccctcggaccctggaccgtgcgt

SEQ ID NO: 36004 - DNA, 401 bp, Homo sapiens
  misc_feature 134: w=a or t
  misc_feature 136: m=a or c
tgtaatgtacacgctaccatactctatgtctacacctccaatatagtactttagtcacccactgcaatcacttgtcttacccgtatgtgctgtaggccccttaggggtagctgctgtgctctattcatctttawgmatctccagtgcctagcacataatctgacatttatagatgcttagtaaatatttgttgaattaatatgttgattaattaaaagataatacaaggcagcttatacccaacagttgagaaaaggttaaactaaaatataaaggggcttaaatgccaagctgaagtttttcgagttcaccctataagccaatgggtccaaataagtaaaccacaatctatttataaatgtctacaccagtagcctccgctaccaccatcacccccacaa

SEQ ID NO: 36005 - DNA, 128 bp, Homo sapiens
  misc_feature 15: r=a or g
  misc_feature 16: r=a or g
aattcaagaacagarraccaaacattgcatgttctcacttataagtgggagctgaacaatgagaatgcgtggacacagagaggggagcaacacacactggggccttttaggggatgggtgaggggcac

SEQ ID NO: 36006 - DNA, 189 bp, Homo sapiens
  misc_feature 104: r=a or g
  misc_feature 105: s=g or c
  misc_feature 127: m=a or c
  misc_feature 132: r=a or g
  misc_feature 137: k=g or t
  misc_feature 139: r=a or g
  misc_feature 143: r=a or g
  misc_feature 145: v=a or c or g
  misc_feature 149: r=a or g
  misc_feature 150: r=a or g
  misc_feature 167: w=a or t
cggaggttctgagcgttctgttcggacctcctaccgttactctttcattcactcaagaaatgatttcttgagttcccggcctttgtcagagagatgacgaggcrsggtccgtgtccagctaaaggamagtargactkgraagravcgtrrttttccaaggtacaggwtgccgcgcctcctaggagccga

SEQ ID NO: 36007 - DNA, 156 bp, Homo sapiens
tatttatttatttagagagggagtctcgctctgtcatccaggctggagtgcagtggcacgatcttggctcactgcaacctctgcctcctgggttcaagagattcttctgcctcagcctcctaagtatctgagattgcaggcacctgcccaccacct

SEQ ID NO: 36008 - DNA, 128 bp, Homo sapiens
  misc_feature 109: s=g or c
  misc_feature 110: s=g or c
taaaccaagtaatctgggtttttgcggcccgcggtcgtctgcgggacacacccacatatagcagcagcgccggggtccagccgccaagctcttccactcgccacgcccssatcagtaatgagcttcca

SEQ ID NO: 36009 - DNA, 140 bp, Homo sapiens
  misc_feature 16: d=a or g or t
  misc_feature 17: k=g or t
  misc_feature 119: r=a or g
  misc_feature 131: m=a or c
  misc_feature 134: r=a or g
  misc_feature 140: s=g or c
gaaactgggagagggdkgaagggagaaagtgagaagggaaatcggaaagagaaaagggaggaaacggcagagccagagagaaagaggaagagactgagtgtgaaggagagaggacacargggatgactgamgaracaccs

SEQ ID NO: 36010 - DNA, 123 bp, Homo sapiens
ggatattttcttaacttgattatggctacctaccagaaatttacaacaaacattaaaatataaatactaggtgcattcccattaaagtcagcaagaaactaagagttcctgtgtctctgcatc

SEQ ID NO: 36011 - DNA, 265 bp, Homo sapiens
  misc_feature 220: k=g or t
  misc_feature 221: s=g or c
ttctgggtttggagagtttggggagcggagacacctcccgaggctcctccgcgttggaccctatttgcgagggcgggagcggggtgggccgacggcgaactccagaggtgggaccctctcccttcagcagctcttcctgacttcatgattctgcccctcttctcattgcaggtcacaccgacaaatctgaagcgggtttgccaggggagtgtacccgtckscccagcctgggccacccggtccacagggattccatttccggccg

SEQ ID NO: 36012 - DNA, 275 bp, Homo sapiens
ccctttgagccatgataggcatgaataacagagctatggatgactttatggttccttgttcattgattccctcaacacatatttaatcagtatctagtggatatgagaaattgtgctaggataagaaaagaagtgcagaattatttaggaacatgtaacagagatggaggacaacacaggaactttctcgggaaagtgacagctaagccaagagaagaaatgagtaacagctggttgtgatggcacatgcctgtggtcccagctactcgggaggc

SEQ ID NO: 36013 - DNA, 359 bp, Homo sapiens
acgggcaggaggtgcaacgcggaaggaaacatcacggattgggggtactggaaacttttaaaaggtctggaaaatccctccgatttagtggatgcttttccgcggcagtttaaaaactgaaaggcaacatagaagcttctactttaaaaaggtagccctggtgatccaatcccgatcttttggctggcaaagaggcaattgcctgaaaacgaaattggcattcaaaaagggtcaggtacagcccagagtccctgtactcattttagactcaagaaaaggcgcttcccatccctagctcttttagaaagagaaaggaaaaggaggagaaagcagaaaggggggagagccgagagcgtgtg

SEQ ID NO: 36014 - DNA, 424 bp, Homo sapiens
  misc_feature 213: r=a or g
  misc_feature 396: k=g or t
  misc_feature 397: d=a or g or t
  misc_feature 410: m=a or c
ttatcattggcccttagctctgaaacttggtagagatgaattaaaaggtgcaaccagtcttctaacttctgcatcagaaattgggttgaagatgtcttacatgaacctgtggcttctgagtatttaacaaacttttatattaaccatctgaacgtttacatctcatctttaatacaaattctggaagtggtggtgcagagttgccagtctgaragattcaggctcagctggagaatgtgttgggcctgaagtaacacaactgtaaacctatttgtggagaacctaaatgcacatacaagtgatttgcctccacatcaaagacctctctgtagtgccttagggtatggtgagggcagtagtccagatagagggccctcagtgactgtcccatctttkdgaacagagcccamagggttgggttctt

SEQ ID NO: 36015 - DNA, 194 bp, Homo sapiens
cccacttgaaatgtttgagagttccagttgatctgcatcctcaccagaacttggtattactagggttgacttttattttttataggcatactgttagatatgtagtggtacagcattgatttaattttttttccccttgtggtaataggtattgaatactattggtgaacttttttaccgtctatttttttttt

SEQ ID NO: 36016 - DNA, 213 bp, Homo sapiens
ccagggacagggagggatgaagcggagatgtcaccagtggtagagaggaaaggaggagagaagaagttggagctggagagcagaggaagtgcagaaaagctgggaacagagagggaaggaggtgaaggaaccactgggcatagagagaaaagttgagggacatttgagggcagagaaggaaggagatgaggaaaagcgaggggcagagtcggt

SEQ ID NO: 36017 - DNA, 74 bp, Homo sapiens
aaaccctcagggacctggtatagacgcagaatctgtttcacacaacaactgctatttgaaggaaaaaaaaaaaa

SEQ ID NO: 36018 - DNA, 92 bp, Homo sapiens
atgcccggccgggcgtttgagggctactgccacgcagcgtttctggagcctgccggctggtgccctggtggcctttatctctgtcccccgat

SEQ ID NO: 36019 - DNA, 194 bp, Homo sapiens
  misc_feature 115: r=a or g
  misc_feature 120: h=a or c or t
  misc_feature 123: v=a or c or g
  misc_feature 124: s=g or c
  misc_feature 126: w=a or t
  misc_feature 140: y=c or t
agtctatgtagtccaagagagtgcatatacgaaatacttgaatgctgctgccggagggctgcgtcctgtctgtggcctagaagcttcctgccgcagctctgaaggagtgaatagrcagthatvsgwtgctaaacccttaycctgagtgaacggggtcaggagaggcctgccagtaccccttttgttaaacagac

SEQ ID NO: 36020 - DNA, 146 bp, Homo sapiens
  misc_feature 15: s=g or c
  misc_feature 16: k=g or t
  misc_feature 29: m=a or c
  misc_feature 118: m=a or c
ctaggcaggcactgskccgtgatccaggmaccacctctctctacagctgggagtgagcaggtcagagagggagacagccttgcccggtgctacccagcaagctagtcaccgagtgggmagagggaggagcggccgtcaccggatgt

SEQ ID NO: 36021 - DNA, 214 bp, Homo sapiens
  misc_feature 14: y=c or t
  misc_feature 15: w=a or t
  misc_feature 158: k=g or t
ttacattgttcagywtcttaaagttgtcttttactaaaactatctgaaaaaaaattgtcaggaaagacagtttttggtattagtctctgaaaaaatgctttcaaaaattcacatcaacgctgggcgcagtggctcacgcctgtaattccagcaccttkgggaggccgaagtgggcagattacttgaggccaggagttggagaccagcctggcta

SEQ ID NO: 36022 - DNA, 116 bp, Homo sapiens
  misc_feature 24: m=a or c
  misc_feature 46: y=c or t
  misc_feature 52: r=a or g
  misc_feature 58: r=a or g
  misc_feature 59: n=a, g, c or t
aaaaattagccaggcatggtggcmcatgcctgtggtctcagctacytgggargctgarngcaggagaatcatttgagcccaggaggtcaaggctgcagtgagctttgatcacacca

SEQ ID NO: 36023 - DNA, 118 bp, Homo sapiens
  misc_feature 72: r=a or g
  misc_feature 73: k=g or t
tttaacaagcttatgaagttagtatttttattttatttagacgaggcatagtcaaggattagataatatatrkaacaagtagtataagatttgaatttgagtctgtcttcccacgcac

SEQ ID NO: 36024 - DNA, 143 bp, Homo sapiens
cccattccatgtctcagaatctctccagttcctgttcattttactttagaataagaggccaggaatggatgggatttaactgattgtacaatactataacttgtacaatcaaggtctggatctggtcttccactacatctgcc

SEQ ID NO: 36025 - DNA, 199 bp, Homo sapiens
  misc_feature 16: w=a or t
ttcatgtgaatactawatttgataattagaattgtcataatatggaatttataaacatttagttaaatatttgttttagatagtgtgcttttcattgcatgttgacacaaaatattttcaggtcttcatcattattgtagaccctatgcctctagtgcctagttgagaacacagccctagttaaaaaaatagactagtt

SEQ ID NO: 36026 - DNA, 164 bp, Homo sapiens
  misc_feature 139: m=a or c
aactcgcggggattgttttccacactgtggaagctttgttcttttcgttttttgcagtaaatcttgctgctgctcactttttgggtccacattgctttcatgagctgtaccactcaccgtgaaagatctgcagcttcamttcagagcctagcgagaccacgagc

SEQ ID NO: 36027 - DNA, 197 bp, Homo sapiens
  misc_feature 60: r=a or g
  misc_feature 124: w=a or t
  misc_feature 182: r=a or g
agctccagtgggcaccgccagcacgcccaggagagtcgcggttgctgatcgtggtgcttragtagagccgtggttggtgacagcatgacgagcgaggtgatagaagacgagaagcaaattctawtccaaggccaaagacctactggaaacaaaatcccacccacggtggacggcatgcttgrggggtatggccacgc

SEQ ID NO: 36028 - DNA, 314 bp, Homo sapiens
  misc_feature 248: r=a or g
ttcacatatgtttttgcatcactgtctctttttttcttgagcttattccagagtgtcttttaatatccattccatgatcaaatggctgaactattaaaatgctgtccagaagtgtaaagcaatatgaagatgctagaaaagttgaagaagacacatatatggtaggtccaagaccattacacttactgagtccattactaaaaatgatgttcacttaacatcaaaacactcaggattacccaagcacratatactgatttgcacctctgcctttgttcatgccccttgttcaggagaactgctttcatgtgcta

SEQ ID NO: 36029 - DNA, 343 bp, Homo sapiens
  misc_feature 128: r=a or g
  misc_feature 284: n=a, g, c or t
  misc_feature 285: y=c or t
tgacacgatctcagctcactgcaacctccacctcccaggttcaagcgattctcctgcctcagcctcccaagtagctggaactacaggcacgcaccacaacacccagctaatttttgtatttttcagtraagacagggtttcaccatgttggccaggatggtcttgatctcttgacctcgtgatctgcccgcctcggcctcccaaagttctgggattacagacgtgagccaccatgcccggcatatatgaagttttaaaaaatcagaatacagaacaaaatttanygggagatgagcttctttctttctctcttcaacaccatcgccacaccaccaagaccaac

SEQ ID NO: 36030 - DNA, 206 bp, Homo sapiens
ttcaagatggattaaagatttaaacgttagacctaaaaccataacaaccctagaagaaaacctaggcattaccattcaggacataggcgtgggcaaggacttcatgtccaaaacatcaaaagcaatggcaaccaaagacaaaattgacaaatgggatctaattaaactaaagagcttctgcacagcaaaagaaactaccatcacga

SEQ ID NO: 36031 - DNA, 318 bp, Homo sapiens
  misc_feature 136: m=a or c
  misc_feature 157: w=a or t
  misc_feature 318: m=a or c
tagtgagcagtgattggccttcaatacttgtgctgagaggaattttaagccaggggaagtgtaagaaaatgttcccattcaggagagattgtgttggagtttctttcttcctctgtatgtattttgtggtgtccamctttaaccacgtttcatccawaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatam

SEQ ID NO: 36032 - DNA, 301 bp, Homo sapiens
  misc_feature 56: r=a or g
  misc_feature 57: r=a or g
  misc_feature 125: r=a or g
  misc_feature 158: r=a or g
  misc_feature 180: b=c or g or t
  misc_feature 202: n=a, g, c or t
  misc_feature 270: w=a or t
gcgggctctgcctcggaggccactcgccgcctgttgtgctgctccgggtgggcgcrrgggtcgcggtgaagggtccgagggtgaggggcgagattcttggaaaaggaagacagggtttcaccatrttggccaagctggtcttgaactcctgacctcargtgatcgcccgcctcagcctcbcaaagtgctggaaattacaggnatgagccaccacgcccggctcaaaggaaatgcccaatgaaacattttagattttggatttttggattwaggatgctcaactggtcatggcaaaacccca

SEQ ID NO: 36033 - DNA, 298 bp, Homo sapiens
  misc_feature 288: n=a, g, c or t
  misc_feature 295: d=a or g or t
catgaaaagggtacaagaacctaagtgttttaagtttcgtagtagttggtcagatttgcattttagaagggtcatctggcagggtgaattaagttggataaaaacaaaccagttagaagactactacaaacactcaggcaagtgatgataggataaatcagtggcagtcggatgagaaaagatggatttgagagatgtccagaagctggaattcacagagtatggcagtgggcctggcatgagcaactgggtgaatgtggtagcagttgctgaaatagggactggacngaaggadctg

SEQ ID NO: 36034 - DNA, 212 bp, Homo sapiens
  misc_feature 167: k=g or t
  misc_feature 197: n=a, g, c or t
  misc_feature 198: s=g or c
  misc_feature 199: r=a or g
ttatgtggaaggtgcttctgttgggcactcagggtcaacggatgcagggcagggtggtcctgaatggcacgctgaagggccaggatctcacaccatgggctgctgagagccactgaaggtttttaagcagggagagctggtggctcagctgagcacagtcactcaakgaagattactctgatggtggaaggggtacnsrgagatgggaaacg

SEQ ID NO: 36035 - DNA, 83 bp, Homo sapiens
  misc_feature 16: k=g or t
  misc_feature 17: k=g or t
cagcatactcaaaatkkttttcctggaatttggagggatgggaggagggggtggggcttacttgttgtagctttttttttttt

SEQ ID NO: 36036 - DNA, 111 bp, Homo sapiens
  misc_feature 16: s=g or c
  misc_feature 93: r=a or g
  misc_feature 102: r=a or g
cagattcaagcacttstcttctcacacaggagtatgcatgggaagaaaaaagagatttgttagtagctgagggtttgagagagggtagtgggrgagggatgragaaggggg

SEQ ID NO: 36037 - DNA, 114 bp, Homo sapiens
  misc_feature 17: d=a or g or t
caagtttacatacagtdaaaaatacccagatgaagctcccctttatgaaatattctcccaggaaaatctagaagataatgatgtctcagacattttaaaattactagcattaca

SEQ ID NO: 36038 - DNA, 106 bp, Homo sapiens
ttagttgagatggggtttcgccgtgttggccaggctggtctcaaactcctgacctcaggtgatcctcccgcctcagcctccctaagtgctgggattacaggcatga

SEQ ID NO: 36039 - DNA, 112 bp, Homo sapiens
  misc_feature 15: k=g or t
taagatggtaaattktatttttatgtttattttactacaattaaaaatttatgtatgtgtgattacttctgcagtacctttgggcaggactcacacacacacacacacacac

SEQ ID NO: 36040 - DNA, 249 bp, Homo sapiens
  misc_feature 37: s=g or c
  misc_feature 111: r=a or g
  misc_feature 124: s=g or c
  misc_feature 128: s=g or c
  misc_feature 142: k=g or t
  misc_feature 143: s=g or c
  misc_feature 150: r=a or g
actagatgaggctcaggccctggcgcggagttgcgcsgcccgcagacccgacttccagccgtgcgacgggctgtctatctgtgccacgcacagccatggcaagtgcttcargctgcactggtgstgtsacctaggatggtgksactgcaratacatgtatcagcctgtgacccctgtggaacagcttccaagcactgagattcctgccaggcctcgggaacccacaaacaccattcagatctcagtctc

SEQ ID NO: 36041 - DNA, 93 bp, Homo sapiens
  misc_feature 16: k=g or t
  misc_feature 17: h=a or c or t
tgagtttggtatcttkhtgattcaaataaggatctttgactctgttatgctttctttagtgatctcacttttctgtgcttggtaacccctgaa

SEQ ID NO: 36042 - DNA, 128 bp, Homo sapiens
  misc_feature 16: r=a or g
  misc_feature 102: r=a or g
  misc_feature 110: s=g or c
catatttttggtagaratagggtttcaccatgttggtcaggctggtctcgaacttctgacctcaagtgatttactaccctcggcctcccaaagtgctggggrttataggsgtgagagccactgccccc

SEQ ID NO: 36043 - DNA, 93 bp, Homo sapiens
  misc_feature 10: v=a or c or g
tatgtgtctvagtgtagctttgtatttatgtgtgtgtgtgtgtgtatgtctgattgcacgggtgtacttttgtatttatgtgtgtgtgtggtt

SEQ ID NO: 36044 - DNA, 89 bp, Homo sapiens
  misc_feature 16: s=g or c
  misc_feature 20: s=g or c
ggaacgggaacaaagsgcasctagggttagcgtgggaagaccctccgcggtctttggcgttttggaaagatacccacacattcccggga

SEQ ID NO: 36045 - DNA, 107 bp, Homo sapiens
  misc_feature 15: r=a or g
  misc_feature 16: h=a or c or t
  misc_feature 17: v=a or c or g
  misc_feature 96: r=a or g
agaggaaagggtctrhvaatatgtacacgcagctgactcaggcaggctccatgctgaacggtcacacagagaggaaacaataaatctcagctactrtgcaataaata

SEQ ID NO: 36046 - DNA, 119 bp, Homo sapiens
  misc_feature 7: k=g or t
  misc_feature 52: k=g or t
  misc_feature 57: n=a, g, c or t
  misc_feature 59: k=g or t
  misc_feature 60: k=g or t
  misc_feature 88: r=a or g
  misc_feature 106: r=a or g
tgttttkaatttattgtattaagatggattctcagatatttatatttttatkttatntkkttctaccttgaggtcttttgacatgtgraaagtgaatttgaatgaraaatttaagcatt

SEQ ID NO: 36047 - DNA, 121 bp, Homo sapiens
cctttgggtatatacccagtaatgggatggctgggtcaaatggtatttctagttctagatccctgaggaatcgccacactgacttccacaatggttgaactagtttacagtcccaccaaca

SEQ ID NO: 36048 - DNA, 109 bp, Homo sapiens
  misc_feature 16: s=g or c
  misc_feature 106: k=g or t
ctttcctttctcgttscccggccatcttagcggctgctgttggttgggggccgtcccgctcctaaggcaggaagatggtggccgcaaagaagacgaaaaagtcgckgga

SEQ ID NO: 36049 - DNA, 194 bp, Homo sapiens
  misc_feature 10: k=g or t
  misc_feature 14: r=a or g
  misc_feature 133: s=g or c
  misc_feature 140: v=a or c or g
  misc_feature 148: r=a or g
  misc_feature 162: n=a, g, c or t
  misc_feature 163: r=a or g
taaggtcaaktgartttctactgagttttcagtagttttcactttaatttcatataattaaagcaacagttatatatttatttatttatttatttattttgagacggagtctcactcagtcacccagggatgsactgcavtggtgcartcttggcttactgnracctccgcctcctgggttcaggcggttcttc

SEQ ID NO: 36050 - DNA, 125 bp, Homo sapiens
  misc_feature 16: s=g or c
  misc_feature 45: k=g or t
  misc_feature 50: k=g or t
aagcaaaacgtgttasccaaatcttacaataaatcattgcaacckgcagkggtaggcattgtcattcttattttgcagagggtgaaactgatggatgcctagcgaagttatttgctaagatcacc

SEQ ID NO: 36051 - DNA, 224 bp, Homo sapiens
  misc_feature 16: k=g or t
  misc_feature 105: r=a or g
  misc_feature 115: k=g or t
  misc_feature 116: s=g or c
  misc_feature 133: r=a or g
  misc_feature 142: w=a or t
  misc_feature 144: k=g or t
  misc_feature 149: r=a or g
  misc_feature 161: r=a or g
ttagtcatcagaaggkccttgtttgttctgtttaagtatttaaaaacattaaggtaaaagttaagcttcattgcatagaaagtatgatgttttacactgaataargggaattatkstaagaatcctgtccccraattaaaawgkccttraaagccccctaraaaggtgttctagtgttctaatacgcattaacctaggaagtattggtgctttgttctggtagt

SEQ ID NO: 36052 - DNA, 241 bp, Homo sapiens
  misc_feature 16: r=a or g
  misc_feature 17: v=a or c or g
  misc_feature 131: s=g or c
  misc_feature 132: k=g or t
  misc_feature 141: m=a or c
  misc_feature 143: n=a, g, c or t
  misc_feature 194: d=a or g or t
  misc_feature 217: k=g or t
  misc_feature 218: k=g or t
tacttgtttattattrvtattttgtatatatcttcaactaatagaggatatcctgtttttaagtttttgtttgtgtaagatttagttgggtacatttgcagatttgttacttgggtatattgaggtgatgskgaggtttgmgngtacgaatgatcccatcacccgaggtactgagcatagtgcccaacagttgdtttttcaacccttatctcctcckkttcctccccttctagtagtcccc

SEQ ID NO: 36053 - DNA, 113 bp, Homo sapiens
  misc_feature 9: k=g or t
  misc_feature 10: k=g or t
  misc_feature 15: k=g or t
  misc_feature 16: h=a or c or t
  misc_feature 86: r=a or g
tgaatgcakktggtkhtgatgacctattaatgatagtagcaaagacaatgttgttgatggagatgacaacattgatggaagtggtratggaagagttcgttgttggtgttgat

SEQ ID NO: 36054 - DNA, 122 bp, Homo sapiens
  misc_feature 16: k=g or t
  misc_feature 17: s=g or c
gagagagagagaaacksatttgctacaagtggaggagacatttatatcagcatcttattctggaattaggagtctcactcttgtcacccaaggctggagtacagtggcacaatcttggctca

SEQ ID NO: 36055 - DNA, 160 bp, Homo sapiens
  misc_feature 14: s=g or c
  misc_feature 15: r=a or g
  misc_feature 119: r=a or g
  misc_feature 131: r=a or g
  misc_feature 141: n=a, g, c or t
  misc_feature 142: d=a or g or t
acactgagtgctasrtagtgggtactcaataaatatcagttaaataaataaatgaatagatagatgtgataccccgcctcttggtcaaggtttccagaaggtgtaatggcctcacctarcatgtcctctcrcaacaggctndcgagacctggcctcgcaa

SEQ ID NO: 36056 - DNA, 87 bp, Homo sapiens
  misc_feature 14: k=g or t
  misc_feature 15: w=a or t
  misc_feature 21: r=a or g
  misc_feature 46: r=a or g
  misc_feature 57: r=a or g
  misc_feature 61: v=a or c or g
tacctctcgtgackwcctgtrttctggggttctgagagggaccgtrcgctgcctggrgaavcaatgcaagtctccatagcctgcaca

SEQ ID NO: 36057 - DNA, 108 bp, Homo sapiens
tctctcctaggacacttgtatttggtaatataatagaatcaacaacaataaacacctgtatttcattaaatctaagatgtcattgatatcactgatgctaggctggta

SEQ ID NO: 36058 - DNA, 104 bp, Homo sapiens
catgaatattttcgtgtctgtctctctctctctctgtgtttcctccagcccttgtctcggagacggtgttttcctcccttgccccattatcttttcacctccca

SEQ ID NO: 36059 - DNA, 124 bp, Homo sapiens
  misc_feature 15: r=a or g
  misc_feature 52: k=g or t
attttagaagagtartagagccagataaggtacattagcacctatgttttaktttgtgggaaaaggtaaaaatattatgctaatttatcatattataatgccaatttgttatatcctgcctatt

SEQ ID NO: 36060 - DNA, 67 bp, Homo sapiens
  misc_feature 18: y=c or t
  misc_feature 27: w=a or t
  misc_feature 36: y=c or t
  misc_feature 51: w=a or t
acggaggtgaggtttgtyaccgcgatwctgagaggygggcttttagtcccwccagacctcggcttta

SEQ ID NO: 36061 - DNA, 58 bp, Homo sapiens
  misc_feature 22: r=a or g
  misc_feature 23: m=a or c
acacttggtttcagggaagggrmaagaggtcaccaagggcagaggtgtccaggccgga

SEQ ID NO: 36062 - DNA, 90 bp, Homo sapiens
aggatccagcggtgtggagtgcagactacccactgctcccacgcctcggggttccctccacagagcgggtgatgctcgggacaacacaca

SEQ ID NO: 36063 - DNA, 99 bp, Homo sapiens
  misc_feature 16: y=c or t
  misc_feature 17: w=a or t
  misc_feature 26: r=a or g
  misc_feature 28: r=a or g
agagtgctgggattgywggcgtgacrarccgcgcccagccagaatagtgttttaagagatctgcttgggaggttttttttgttttgttttgttttgttt

SEQ ID NO: 36064 - DNA, 132 bp, Homo sapiens
  misc_feature 32: s=g or c
  misc_feature 33: s=g or c
  misc_feature 40: m=a or c
  misc_feature 51: m=a or c
  misc_feature 69: s=g or c
  misc_feature 70: m=a or c
  misc_feature 131: w=a or t
  misc_feature 132: r=a or g
tacagtcattttttttaaagaaaaagtattassgaatagmatttccagagmaggtaagacacgtatcasmaataaaagcacaaggcgttttgaaaagctaggtgaaataagggaggaacactggagagttwr

SEQ ID NO: 36065 - DNA, 278 bp, Homo sapiens
  misc_feature 127: r=a or g
  misc_feature 139: w=a or t
  misc_feature 140: s=g or c
  misc_feature 141: w=a or t
  misc_feature 143: d=a or g or t
  misc_feature 261: r=a or g
tgcattcttcaaattcttaacagtcgccatccataaatgtctttttttgtacaagtaggtgataaaatatttaaagccaatttttaaatgtttcaaagatatttaacaattggaatttatatcctarcagctttttctwswtdgtttcactgacaagtatattgttaaaacttctcatgatgatgtgagtagatttcaaatccagttgaacgctttcatattaacaatttcaaaataatgatgaagctcttatttgcagarcatgcatcattattaga

SEQ ID NO: 36066 - DNA, 107 bp, Homo sapiens
  misc_feature 68: m=a or c
  misc_feature 80: v=a or c or g
catttcaaccttacagagaaattagaaaccatcagatgggatatccttcattctgataccaaacatamatctgacatgtvaacaccccttccttcagcttcacctat

SEQ ID NO: 36067 - DNA, 195 bp, Homo sapiens
  misc_feature 152: y=c or t
aaaacggtccggggctgagctgcagtcagatccggggatggagggagccggagaagaggagtgagaaggccggggaggcaggccctgctgtcttcctgcaggccggcagcctgctggcagtggaggaccaggccgtccaggaaaggaagggygcaggaggtcgggcagggcctcagcaggttcagacaagtcccc

SEQ ID NO: 36068 - DNA, 72 bp, Homo sapiens
  misc_feature 15: b=c or g or t
ttttgtttttttgabacggagttttgctcttgctgcccagtctgaagtgcagtggtgcactctcatttcact

SEQ ID NO: 36069 - DNA, 84 bp, Homo sapiens
  misc_feature 10: s=g or c
  misc_feature 14: k=g or t
  misc_feature 15: y=c or t
agacgcggastggkyaaaagggaggcagaggaggcggaggcagaggcagaggcagagcccggtgccgagaccaagcgacagacc

SEQ ID NO: 36070 - DNA, 163 bp, Homo sapiens
  misc_feature 146: m=a or c
  misc_feature 147: r=a or g
  misc_feature 150: r=a or g
tacttctcagcctgtatcaattgtacccagggttcatgattactgtgacccactaagggacgatctttgaggaaacagacctggagggaggtaatttaaggagggaaagtgagtgggttttacagactgctttgtggcgacattcmrggracaagaccaaagt

SEQ ID NO: 36071 - DNA, 108 bp, Homo sapiens
aggaaaactttctggtagcagtgctgttactgtctgttgtggggttacttagatttgtctctgctcttcaaggtgctccagatttattgtcattatctacggggaact

SEQ ID NO: 36072 - DNA, 384 bp, Homo sapiens
  misc_feature 155: m=a or c
  misc_feature 165: s=g or c
  misc_feature 306: k=g or t
  misc_feature 307: r=a or g
  misc_feature 331: m=a or c
  misc_feature 332: s=g or c
ttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaaatgmcagctttagsacaattttaagaaaatgcccctctctattaccacattttctcttattaacagtatctcagaataattttctttccttagaaacctgagagaatgctagtcataactgtactagttactatgaaaatggaaataattatctkrgaatattttcaaagtagagcgtgmsatgtatttttagtgggagagctctgatagttgttgggaatatataatttact

SEQ ID NO: 36073 - DNA, 320 bp, Homo sapiens
  misc_feature 146: r=a or g
  misc_feature 285: m=a or c
  misc_feature 286: n=a, g, c or t
  misc_feature 287: n=a, g, c or t
taagttctgtaaaaacaagtgctattgaaattgagaataaaaagagtgtaagtctaattaagggaaatctgactatcttagaatgcttccaacggtaggtggttatgagctgggccttaaagaatggccccaaataaggaaggtarttttttgaggaagggtttttctggcaagaagtcagcccagtggaggaaggtggaaaggaaagtttcaggtgtattccattacctgggagcagacatgaatgaatggaatgtaagagggtagaatgggagatcggatggmnngagttcagttggagagcatgtcatggaagagct

SEQ ID NO: 36074 - DNA, 340 bp, Homo sapiens
  misc_feature 151: r=a or g
  misc_feature 152: m=a or c
  misc_feature 153: y=c or t
  misc_feature 157: w=a or t
  misc_feature 165: d=a or g or t
ttttttctgtttaaatcttcagttcagatctgattttggttatttcttgtcttttcctagcttaggggttggtttgctcttgctttctctcattcttttattcatgatgttaggttgttaaattgagatctttgtaacttttggatgtgarmytttwagtgctadaaatttctctttaacactgccttagctgtgttgcagagattctggtatgttgtatctttgttctcattttttgcaatgaacttgatttctgctttaatttcattatttactcaaaagtcatttagactcaggtggcataatttccatgtatttgtatcacttcaagtgttttttt

SEQ ID NO: 36075 - DNA, 158 bp, Homo sapiens
  misc_feature 100: k=g or t
  misc_feature 142: r=a or g
  misc_feature 143: m=a or c
  misc_feature 156: r=a or g
  misc_feature 157: m=a or c
cacaaaagaatggaaatcataacaacctgtctctcagaccacagtgcaatcaaattagaactcaggattaagaaactcactcaaaaccacacaactacakggaaactgaacaacctgctcctgaatgactggtaaaaaatgrmaatgaaaggcagrmc

SEQ ID NO: 36076 - DNA, 301 bp, Homo sapiens
  misc_feature 152: w=a or t
  misc_feature 154: y=c or t
  misc_feature 156: w=a or t
  misc_feature 159: w=a or t
gaaatatatataacaaaaaaatgctacaaaatcatatgggccgggcaaggtggctcacgcctgtaatcccggcactttgggaggtggaggcggatggatcgcttggggtcgggagttcgggaccaagcctggccaatatggtgaaatctcawcycwacwaagggtacagaaattggctgggcatggtggtgtgtgcctgtagtcccagctactcagggatgaggcacaagaatcacttgaaactggggtgcaggttgcagtgagttacctcgccactgcactccagcctgggcaacggagt

SEQ ID NO: 36077 - DNA, 156 bp, Homo sapiens
catatcattttactcataaatatttaagtatatatcttaacacataaggactttaaaatcataaccataatattgatatcagacccactgaaattaatattctaatagtgggtgcatttttaaaattcaaatgaatatgaaacaaccagagtccac

SEQ ID NO: 36078 - DNA, 101 bp, Homo sapiens
  misc_feature 71: w=a or t
  misc_feature 72: d=a or g or t
  misc_feature 73: y=c or t
  misc_feature 77: w=a or t
acaaatggcatatgttttccacttctttgcatgcgtttaagtcagtttatacacaaaatggattttatttwdyagtwtaactgtgtttctccgacagctca

SEQ ID NO: 36079 - DNA, 303 bp, Homo sapiens
  misc_feature 103: w=a or t
  misc_feature 108: w=a or t
  misc_feature 119: m=a or c
  misc_feature 121: r=a or g
  misc_feature 251: w=a or t
aattgcgacttacttgttacagcagaagcttcaagaatttacactcattggaataataaaatagaagtaagcaaccgtgcattaaaaagctatgaaaagatgwagagwattatgccttmaratgggaaggaatacttaactgtgaataagacctagttcaacatggaacttcctggtggccaagtcagaagagaagcacagaacaaaaacggaggcacagagaggtcaattgattggtctaatgacacagwtctagcaagtggtggaaccaggactgaatccaggtgtgtgtccggaattggt

SEQ ID NO: 36080 - DNA, 108 bp, Homo sapiens
cagtggagaccttacagagaatgcacactacatttgagcatgacatccaggctctgggcacacaggtgaggcagctgcaggaggatgcagcccgcctccaggcggcct

SEQ ID NO: 36081 - DNA, 305 bp, Homo sapiens
  misc_feature 34: w=a or t
  misc_feature 94: k=g or t
  misc_feature 114: w=a or t
  misc_feature 115: k=g or t
  misc_feature 116: d=a or g or t
  misc_feature 121: d=a or g or t
  misc_feature 124: k=g or t
  misc_feature 134: w=a or t
  misc_feature 136: k=g or t
  misc_feature 145: k=g or t
  misc_feature 152: d=a or g or t
  misc_feature 264: w=a or t
  misc_feature 267: w=a or t
  misc_feature 268: k=g or t
  misc_feature 300: w=a or t
agcctccatttggcatcattcacaaactactcawggaagaatttgctttcccagttgtatgtataatttaagtcgtttactagatagaactttkttttaggtttagatggccawkdcatcdtakatggtttagwakgcagagtakacatttdcctttgcaaacagtatgagttaaaactttctatgctaaatgagaatgcggcataaagtctccacttactgaaatttaaagattcaacaagacaaaccgagaagggggtcagwggwkctctaggaaaggcccaggagagggcagttggwggcac

SEQ ID NO: 36082 - DNA, 250 bp, Homo sapiens
  misc_feature 107: w=a or t
  misc_feature 113: w=a or t
  misc_feature 142: k=g or t
  misc_feature 145: w=a or t
  misc_feature 154: k=g or t
  misc_feature 202: w=a or t
  misc_feature 208: d=a or g or t
caatggtaacaaagttgagaaatactggtgtagaccaattcaatttctctaatggttataggtcttttatgaaatatatttgcaagttgtcctcttctagtaagtcwtttaawtaaaaagtttatatgcattggctaacttkgtwattagtttkttcttagcattttaaatctctgctataattgtatcactgttgctattwattgtdagtattgttcattttaggtgtctgcattggctaatgccatgt

SEQ ID NO: 36083 - DNA, 420 bp, Homo sapiens
  misc_feature 14: b=c or g or t
  misc_feature 142: k=g or t
  misc_feature 175: k=g or t
  misc_feature 176: h=a or c or t
  misc_feature 302: n=a, g, c or t
gttttaaagggaabcagaaaaggagagaatatgctattgtggcacttctaaaatgcagagtgtcctcaaagatggttatagtgggtaatgggtttcatataaattgcatactagagtatctccatttcctcttttaattgtkttaattggttttttaaagcttgatatgctgagkhagttttcatttaaaaacaatgcttgagtaggaaagttaaagaaatagaaattgcctgttttaatctattcatcctggcagcaggtatgtattgtatctgtccagagtccaaaacgtcagctccctncacttgccttccccatttcacataaactataaaagttagaaataatatattatgtcatatcctaacatcagttcaatgaatatagtttttaaaatacctactatgtgctagatactga

SEQ ID NO: 36084 - DNA, 421 bp, Homo sapiens
  misc_feature 93: w=a or t
  misc_feature 113: w=a or t
  misc_feature 123: w=a or t
  misc_feature 128: m=a or c
  misc_feature 129: k=g or t
  misc_feature 130: r=a or g
  misc_feature 146: m=a or c
  misc_feature 220: w=a or t
  misc_feature 351: y=c or t
  misc_feature 352: k=g or t
  misc_feature 353: k=g or t
  misc_feature 361: w=a or t
  misc_feature 382: m=a or c
  misc_feature 383: n=a, g, c or t
  misc_feature 384: n=a, g, c or t
tagtttcatgtcccggctctgcctgctgtgtgatcttgggcaagtccttctctatggctcatttcttcacctgtaaaatagggataatcaggwttttttcatggggttgaggwtgagttgaawgttcmkraagtgataactccagmaccgtgcctggcctagaggaagcactaagggtgaagcagcttttactatgaataggaggcagcaccggaggggwtcgtctcaaacaggagagagcgctggtttcagcttttgccctttctccggagtgactcctcaatcagacagggggaaggtggggtgtccactatctcatcattgccaggagcctccctgcaacaaccaggykkggtggtcwtgtcccattttatagaccagmnnagggaagttaaggaacttgccccaggtcagccagaca

SEQ ID NO: 36085 - DNA, 265 bp, Homo sapiens
  misc_feature 106: w=a or t
  misc_feature 112: s=g or c
  misc_feature 114: k=g or t
  misc_feature 116: m=a or c
  misc_feature 125: y=c or t
  misc_feature 128: r=a or g
  misc_feature 142: k=g or t
tgcattgttggaggagcccatttcactgcttcactgttctggaagtgattcccctttactcatttatccttaagctcagagttttccatttgtttctgaagattcwatttgsckamtttcttatytarccattgaaaatgckttttgataagttttagagtcccctaatcaactgtctacatttccttatgtatcacaattagaattatatgctaacgtgctaacgcagggatatttctcttttctttttctttctttttttttt

SEQ ID NO: 36086 - DNA, 211 bp, Homo sapiens
agtccaaattccaatttatagggattctaggaagagaaaaatgtgaggcagatattattaaacaattaacataagaaacctttcagaactgaagatcatgaattttaagacccaccaatgcctagcaccagtgagtggaaaaacacccactcatttgggtgcattttcatgatggagttctacagactaagtgataattgtaaaagccccc

SEQ ID NO: 36087 - DNA, 104 bp, Homo sapiens
  misc_feature 36: s=g or c
  misc_feature 37: k=g or t
  misc_feature 40: n=a, g, c or t
  misc_feature 94: k=g or t
  misc_feature 97: k=g or t
atttgtctgctccaggtgctagccaggcaggcgcasktgngccggctagggctggaagtgtcagcggcggccgcgggcccggcagaaggccgaktakgaggaac

SEQ ID NO: 36088 - DNA, 309 bp, Homo sapiens
  misc_feature 113: d=a or g or t
acaatagtgttaggctgtaatgtcattctttaagaatcttttccagtaaacatttgttactttttcaaagtaattgggagctgttgagtgtggaagcgaaaaccaagttaagdagtcctgttatttgggtcatggtctacgtgaaacatcaaagaaacctgtaacggaaaacgacttgtttgaaagagccagttctctatccaaatttaccaatcagaatcttgcactgaaaagataaaccaatcgtgaatctctacggccacttccggaatttagcaaccgatcactaacagggatcgtccacaagcg

SEQ ID NO: 36089 - DNA, 328 bp, Homo sapiens
  misc_feature 111: r=a or g
  misc_feature 297: n=a, g, c or t
  misc_feature 298: n=a, g, c or t
  misc_feature 299: s=g or c
  misc_feature 305: s=g or c
aggaccacggaatcctgttctctaacccaaggggcagtgtaggtggttttaagcccacagaatattgagatatttctcttgtggttttggtggggtggtgggatgcagaargttaattaaagatcaattttaagcatcagatagactatcccttttatttttttaacttttaggttcaagggtacatgtgcaggttgttatataggtaaactcatgtcaagtggttttgttgtacagattattttgtcacccaggtgctaagcctagtacccagtagttattttccctgctcttctnnstcctcscaccctccaccctcaagtaggcc

SEQ ID NO: 36090 - DNA, 271 bp, Homo sapiens
taatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccccaa

SEQ ID NO: 36091 - DNA, 144 bp, Homo sapiens
  misc_feature 109: m=a or c
cacgggccccacaggcatcaagtatgacctggaccggcaccagtacaactacgtggacgctgtgtgctatgagaaccgactgcactggtttgccaagtacttcccctamctggtgcttctgcacacgctcatcttcctggccca

SEQ ID NO: 36092 - DNA, 83 bp, Homo sapiens
  misc_feature 15: b=c or g or t
  misc_feature 32: k=g or t
tatttccatctttabgtctgtctgtacccatkgtttagctcctactttataagcaagaacacgcagtatttgattttttgagt

SEQ ID NO: 36093 - DNA, 233 bp, Homo sapiens
  misc_feature 18: w=a or t
  misc_feature 32: w=a or t
  misc_feature 38: b=c or g or t
  misc_feature 46: w=a or t
  misc_feature 81: h=a or c or t
  misc_feature 106: v=a or c or g
  misc_feature 110: r=a or g
  misc_feature 112: s=g or c
  misc_feature 121: w=a or t
  misc_feature 122: r=a or g
  misc_feature 126: m=a or c
  misc_feature 135: v=a or c or g
  misc_feature 138: m=a or c
  misc_feature 142: d=a or g or t
  misc_feature 146: r=a or g
  misc_feature 153: k=g or t
  misc_feature 187: d=a or g or t
  misc_feature 204: r=a or g
agacagttttgaagtttwcaaagactggctcwgctgtbaagaagtwgtacttaaagcggaggagctaagccacctgccaahatgtgcaaaggacttgcagctttgvcccrastccatgccwrggamaagggccavggmgatdaagrtcaagtkgggaattctcctccagaagccagactcagttggdgaccttgtcattccgtrcaatgagaagccagagaaaccagccggcc

SEQ ID NO: 36094 - DNA, 383 bp, Homo sapiens
  misc_feature 328: s=g or c
  misc_feature 329: n=a, g, c or t
  misc_feature 330: n=a, g, c or t
taccatgactgctttaatagattgccaagctgcgcttcatacctagtgaatcataacatccgaagcttcctagaagagtcggaccattagactggagggataactactcgcttattcggttgccttcaggaaaggggaatttatgtgcttggttattgggctgattaatagcaggacaagaaatcttattgtctctgtagattcatccaaataatatccaaatatatatataatgtttgtttgagatggggtctcactttgcccccctggctggagtgcagtggcacaatcacagctcactgcagcctcaacctacccgggctcaggsnntcctcctacctcagcctcctgaatagctaggactatagacacgtgcccctgca

SEQ ID NO: 36095 - DNA, 109 bp, Homo sapiens
ctttgccagtgctctaagtgataacatttctttgtggtttaaattgccttactgggccgggcgccatggctcgcgcctgtaatcccagcatgttgggaggctgaggcgg

SEQ ID NO: 36096 - DNA, 146 bp, Homo sapiens
attagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccgt

SEQ ID NO: 36097 - DNA, 237 bp, Homo sapiens
taaccaacaaatcccataagtggaccttttaggaagataacatttctatccatgagcatagccactataatcacaagacatttatctcaagcaagatagagtcaagatactctcacaacctcaggggctggaactgtaaattttcacatcctgccaacacccttgaatagctatgtcaagaatttagtgtctgtaacttgttctttattttaaagtacatttaacatcatcggcgcc

SEQ ID NO: 36098 - DNA, 319 bp, Homo sapiens
  misc_feature 110: k=g or t
  misc_feature 111: w=a or t
  misc_feature 113: d=a or g or t
  misc_feature 170: r=a or g
  misc_feature 253: d=a or g or t
  misc_feature 314: r=a or g
taatctttaagttgagatcagaatatcaacaaagagtcagtcatgcaaaaatgaattgcttagttcttttgttaaaaactagaatgttagagctatgtccaactttcaakwgdtggcaggcttttgtccaagtaatatatatgtattagtccattttcacaatgccagaragatactacctgagactggttaatttataaacaaaggaggtttaattgactcacagttccacacagctggggaggcctcaggdaacttacaatcgtggggagggtgaagcaggcacattcttcacaaggcggctagaaaggtaragaga

SEQ ID NO: 36099 - DNA, 412 bp, Homo sapiens
  misc_feature 337: y=c or t
  misc_feature 338: w=a or t
tgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagywcagccagtggcctcctgctctggcagggtgtggaggtgggagaggccggccaaggcaaggacttcatcagcctc

SEQ ID NO: 36100 - DNA, 77 bp, Homo sapiens
cttcttgttcggcgtgggcggctcctggcagacccatcccgcggtgcagccgccggcccggtaggcgccaggacccc

SEQ ID NO: 36101 - DNA, 391 bp, Homo sapiens
  misc_feature 148: s=g or c
  misc_feature 149: k=g or t
  misc_feature 162: b=c or g or t
  misc_feature 305: h=a or c or t
  misc_feature 319: n=a, g, c or t
tactattgttgccacagggctactggcgcaactacttgagctgcacgtctgcccacaccagcaccagcgacggcacggccatgatcaccagggcaggccttccttgccaggacctcgagtttgttcagttccaccccacaggcacatskggtgctggttgtbtcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgahggaagagagctggngccctgagaaagatcacgtctacctgcagctgcaccacctacctccagacgcagctggccatgcccttgccc

SEQ ID NO: 36102 - DNA, 254 bp, Homo sapiens
  misc_feature 142: s=g or c
  misc_feature 143: y=c or t
acggttcgggcggtgggcgagagcgatccgttggggagagacgatttgacatcagctaaatccctctctgccgaggagttttcggagctcttctcctcctgttcgccctcgtctttgaaggaaatcagttcgtcgttggcgsytaggtcatcccctccaccgccgttcagctgcggcatttttttttcacccaccagcagcaattttggaagaaaaatgaaggaggaagaaaagccaaaaaaaatcacccttcc

SEQ ID NO: 36103 - DNA, 93 bp, Homo sapiens
  misc_feature 42: k=g or t
caccagtggaatgttcgtttgtcttttcccaaaaagtaccaktattggaaagaaagatagccttagcaacagggtgtcttaataacaacattt

SEQ ID NO: 36104 - DNA, 270 bp, Homo sapiens
  misc_feature 15: s=g or c
  misc_feature 124: r=a or g
  misc_feature 149: s=g or c
  misc_feature 150: s=g or c
  misc_feature 238: n=a, g, c or t
gaaaaaaaagaatcscagcactttgggaggctgaggcgggtggatcacaaggtcaggagatcaagaccatcctggctaacacggtgaaaccccgtctctactaaaaatacaaaaaattagccgrgcgtggtggcgggcacctgtagtcssagctactcgggaggctgaggcaggagaatggcgtgaacccgggaggcagagcttgcagtgagccgagatcgcgccactgcactctagnctgggcgacagagcgagactctgtctcaaaaa

SEQ ID NO: 36105 - DNA, 392 bp, Homo sapiens
  misc_feature 9: d=a or g or t
  misc_feature 10: r=a or g
  misc_feature 68: k=g or t
  misc_feature 125: b=c or g or t
  misc_feature 126: w=a or t
  misc_feature 127: r=a or g
  misc_feature 183: s=g or c
  misc_feature 184: r=a or g
  misc_feature 331: w=a or t
  misc_feature 339: d=a or g or t
  misc_feature 347: r=a or g
  misc_feature 348: s=g or c
  misc_feature 354: n=a, g, c or t
  misc_feature 355: n=a, g, c or t
tttctttgdratcctacttttaattcttttgaattgaatataattcgacctaaaagtgggttgctggkacatttggtaattttgtttttaatttttgaggcactgccatactgtttttcatagcbwrgcaatttttacaatcccttggacagtgtacataggttccagtttgtcagcatgctsrtcaaagctttccatttggcatgtttgatgtgttttttatagttgaattatggaaattctttatatttgctgaaaattaagaccataccagatatatgacttaccaacattttctccaaattgatgagttttcttttcccttgttgawagtgtgtdcccttgcrsaaaagnntttaattttcataaatcacattacctttttgttaaga

SEQ ID NO: 36106 - DNA, 170 bp, Homo sapiens
  misc_feature 155: s=g or c
agtaacaaacatggctccctgaagccgctcaggctcaagagcaacatggaggtctgcacttaatcgctcctctccgggggcggccatactgaggaggcatctcttccgtgcaggcaggctctcctggggacctcagagattctctccagcggcasagaaaacgggcaggg

SEQ ID NO: 36107 - DNA, 191 bp, Homo sapiens
  misc_feature 120: m=a or c
  misc_feature 129: v=a or c or g
  misc_feature 132: k=g or t
  misc_feature 136: r=a or g
  misc_feature 152: r=a or g
  misc_feature 166: w=a or t
taagacatatcctgatatctcattttaatgcagttacttttttaaagaccttatctccaaatagagtcacattctgaggtacttggggttagggtttaaacatactaattttggagggamacatttcavcckatartaatacaatatttgaratttgttcagctgwtgtttaaagtaaatatgagggaact

SEQ ID NO: 36108 - DNA, 238 bp, Homo sapiens
  misc_feature 204: r=a or g
  misc_feature 225: n=a, g, c or t
cacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcartaatgctaaaattagctacgnttctgctgaccct

SEQ ID NO: 36109 - DNA, 102 bp, Homo sapiens
cttttcttttccttttttccccgctgtgcctgaatctcccgggacacttagacggctggagcctcccgactccaaggcgggcgacggcaaagttaaacgcca

SEQ ID NO: 36110 - DNA, 314 bp, Homo sapiens
  misc_feature 134: m=a or c
  misc_feature 169: n=a, g, c or t
  misc_feature 272: r=a or g
  misc_feature 273: n=a, g, c or t
  misc_feature 274: n=a, g, c or t
tataaatgggagaaaatcacctgtccttgccaagggtccggtgggaattaaatgagctgagccagggcacgggtggagcttgctgagtgttaggtcgtgtgcctgctcttcttggcggagtcttggccagatamctcatctggttccattgcttgtcagtctctaaatngggcctttcctgcccagctcccagccctggtgctcacaccatcacaggccaaagaactggattccagacactgcctcctccactgtccccacagtgaaaatgrnnagggatgtccctgtggagccctaactgggacccagacagc

SEQ ID NO: 36111 - DNA, 204 bp, Homo sapiens
cacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcacac

SEQ ID NO: 36112 - DNA, 57 bp, Homo sapiens
  misc_feature 34: w=a or t
agtgaaagccaccgttgcccggggatgggtcccwgacacttggggaagtaggagccc

SEQ ID NO: 36113 - DNA, 165 bp, Homo sapiens
  misc_feature 149: s=g or c
tctagttccataatttactcaaagatttatttatggagtagtagttaagagagtagatactgggatgtagattggcctgggttccaattctgactccatcatttaatagttttataatgttaaagaagttatttgaacttcttagtgtsataatttccttggcat

SEQ ID NO: 36114 - DNA, 159 bp, Homo sapiens
agacacacagggcattgtccctcggtcaacagcccctgggcacctcagctcggctcctggcctgcccccacgcccctcaccgcctgccactgcgctaggctcagccagctgggggcccaaggctcccagctgatgacgagcccacccactcactcccca

SEQ ID NO: 36115 - DNA, 473 bp, Homo sapiens
  misc_feature 425: r=a or g
atgacaggaccttggtgcgtgttgaatgacatgaagccctttgctccctaaagtaggaattcccaatcctggtcttccaatctctgaggcttgctgagttttttcccaactttttagaaattatgagaaaaaaataattttaatttactttttatttttaaaaatacatagaaaatggccgggcgcggtggcttatgcctgtaatcccagcactttgggaggcccaggtgggcggatcacctgaggttgggagtttgagaccagcctgaccaacatggagaaactccatctctaataaaaatacaaaattagccgggtgtggtggcacgtgcctgtaatcccagctactcaggaggctgaggcaggagaatcgcttgaacccgggaggcggatgttgtgatggggactctctatatccaatgaaraggactccctagaaaatgggcagtccctgagctccaagccagctgtct

SEQ ID NO: 36116 - DNA, 261 bp, Homo sapiens
  misc_feature 149: m=a or c
tggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggmtggctgcggggctccaagtaagttattgggatgttttttatattccaggggtgctgtacattcttattttattttcacaacagctctgtgatgtaaatgctatctccatgaa

SEQ ID NO: 36117 - DNA, 116 bp, Homo sapiens
tctgtttcttccttgtgggtgtggggcaggaccctctctggaatgcaggtctgtcttatgacctacagtcaaacaagtgctttggacttctaggggtgaatggagctgggaagcga

SEQ ID NO: 36118 - DNA, 199 bp, Homo sapiens
  misc_feature 27: s=g or c
  misc_feature 28: m=a or c
  misc_feature 127: k=g or t
  misc_feature 129: n=a, g, c or t
aactgaataaggaaacaactttataasmgaaacagtggtcttcaatcttttaaagacatgaaatcctatatggcattctgtctcagtgagtcagttaacaaatacgtatgtgcaacccttctgctaktngtgcacataagtgattatccctgccaggtatcgagttggaatatccagttatttcatgtcacacatcggc

SEQ ID NO: 36119 - DNA, 141 bp, Homo sapiens
  misc_feature 46: y=c or t
  misc_feature 55: w=a or t
cacttataaggcctgattggtcctacccagcttaacggggtggggyttttttgtwtgttcagacagtctgttcttttgtaaacatttttagttggaaaaacagcatctgcattttccccatcctctacgttttagagagga

SEQ ID NO: 36120 - DNA, 287 bp, Homo sapiens
taattacctgggcatggtggtgtgcacctgtaagtcccagctacttgggaggccaaggcaggaggattgcttgaggccaggagatcaagaccagcctgagcaacatagtgagaccctgtctctacaaaaaatttaaaaattagctgggtatggtggcttatgcttgtaattccagctacttgggaggctgtgacaggaggatctcaggaatttgaggcagcagtgagctatgattgttgcacaggctggagtgcagtagcacagagtaagaccctgtctctaaatac

SEQ ID NO: 36121 - DNA, 133 bp, Homo sapiens
  misc_feature 8: m=a or c
  misc_feature 31: y=c or t
  misc_feature 49: m=a or c
  misc_feature 50: m=a or c
  misc_feature 61: m=a or c
  misc_feature 106: w=a or t
tgcatagmatcccatttttgtacagaattgyaatgggatggaataggtmmgcaaaagtagmagcccatttgagttttacatttgattccacaatttggtttcaggwaggcttggtaatagactatataaacca

SEQ ID NO: 36122 - DNA, 196 bp, Homo sapiens
catgtgggcaaagagcaaagatagacaaatatttattctattccattgggacagccaagaaaaattgtgtcaggtttttataagctgttatttcttgtggtttttctgaaggtttttctcttgggggtggcatgggcagattttttttcttcatcctgtttgtgccatagctagatctgagtcaattgcggctggg

SEQ ID NO: 36123 - DNA, 200 bp, Homo sapiens
tgagctttttcacctttccagtttgcttcaaatgctaaatgactgtagaatggtcaacgttgagttctttggcaacctcttgtatagttgatcagccttgatgattgctctcaattggttgttgtcaacttccaatggccagccactgtgatcttcatcttcaaggctcttgtctcctttgcaaaacttcttgaaccacc

SEQ ID NO: 36124 - DNA, 135 bp, Homo sapiens
  misc_feature 118: w=a or t
cccaggttcaagctattctcctgcctcagcctcctgagtagctaggattacaggcgtgcaccaccacacctggctaatttttttatttttagtggagacggggtttctccatgttggwaaggctggtcttgaatt

SEQ ID NO: 36125 - DNA, 208 bp, Homo sapiens
tctaaggacaatatgaaaacttaagcattatgtaggtagagttgtgctaactgtcctgcccccccagatggaaaaggaatgagggggcaggaaaaagtcagtcaaaatgtcagcagccacaccctgttgccttcacaaggaccccgttttatgcagagctggttctgctaatcatggggatcgtcagtgcttcacttcccaccccccc

SEQ ID NO: 36126 - DNA, 52 bp, Homo sapiens
ttagtgatgtgttacccaggatgcagcaggtgtgtgcaggtatcttgctctc

SEQ ID NO: 36127 - DNA, 94 bp, Homo sapiens
catttgttgaagtgtttcaaagtactcctttcataagaataccgtgtgtgtgtgtgtgtgtgtgtgtgtaattttttttttttttttttttttt

SEQ ID NO: 36128 - DNA, 443 bp, Homo sapiens
  misc_feature 359: k=g or t
  misc_feature 368: d=a or g or t
cataaattgccagcctctggtgtgttgttgtagcagcacaaaaagactaagagtcagatacttgtctcaccaaaatctcagatgggatgacaaaacgatttaaagaaatcaagtttgatagctgctcagaatcttgaaggtccacccttagtgacagaggcagtcctcaaattcatatgagatgagatgtactgttcaaaaattgtgcttgaaggccactggccaaatgtttataacagatctatctacatgtcataaagagcgtgaagccccatttttaagagggagctccagctatcattaagttccttctcccaagacccctcccaacttctgggggtctaggtcccctgcttctkctgccctgdtagctgtgatctgctcctcttgagagggctggtgtggcaatagcttccccagggactcagccccactcagctcct

SEQ ID NO: 36129 - DNA, 98 bp, Homo sapiens
gaatggccatctaatttagatcttagaaaagagttgtctgaaccaagcagcacgcgtatctatgccattgccaaggtaagatgttacaaggggccaca

SEQ ID NO: 36130 - DNA, 368 bp, Homo sapiens
  misc_feature 351: k=g or t
  misc_feature 352: n=a, g, c or t
actaaagtaagtgaaatttatttttaaacgtagctttcttcattcataaagtttatgttcattgtaggcagtttggaaaacagcccataatctcaccactcggagattacattgtgaataatttggtatatttccttttagaaatataccaaattatccttttttcctctgagtgtatgaatatttatatttgtttttaacatacttgagctcatagtgctcagtatttccaacgttctgtttatttaagatgaaaattgctgtagttaataagcacttccccatgtcattaaaatgcttaaggatttttaatgaccacataacagtccataatatgattaaaccccaatknactgaatcaatgcccc

SEQ ID NO: 36131 - DNA, 291 bp, Homo sapiens
cccgtaaactctacttccaatgtgctgactattccagaatgtacccctttttctccatctccagcgctaacactccgtcccagctcccatcacttctcctgaacttccgcagtgtcgactccaccctttaattaattaattctccgtaaagcagctggagcgatttttgtaaaacagataatgcagtttgaaaatggccaaaggtagaacgcttttacactgttggtgggaatgtaaattggttcagccattgtggaagacagtgtggtgattcctcagagacctagaccc

SEQ ID NO: 36132 - DNA, 274 bp, Homo sapiens
  misc_feature 173: r=a or g
aaaaactatgcctcaagattgcttggcccactccaaagcaaagcagctcaccaagccactggtaaactctgtagctttcacatctgacggaaaactcccgcagaagagcggactacagggaggagtgtgaagattatacaagcagattttacaaaagatgacatctacgagcrtattaaagaaaaacttgcaggcttagaaattggaattttagtcaacaatgtcggaatgcttccaaaccttctcccaagccatttcctgaacgcgccggatg

SEQ ID NO: 36133 - DNA, 278 bp, Homo sapiens
  misc_feature 153: n=a, g, c or t
  misc_feature 154: s=g or c
  misc_feature 263: w=a or t
atatctgccaaagctgttcaggataagcttgaccaaatggttttcatttgggagaacatacacacactggtggaagagagggaagccaaactactggatgtgatggagctagcagaaaagttctggtggtgatcacatgtcattgatagttansattaaagatactcaagatttcatccgggacctggaagatcctggaattgatccttcagtagtaaaaacaacagcaagaagcagcagagaccataagggaagaaatagawggactacaggaggta

SEQ ID NO: 36134 - DNA, 106 bp, Homo sapiens
cttttgcaatctttttagtatatttcactgagtaagataaaggaaatacatcatgtagccagaaattatcagtagcttacttctctgatagtaggtaattatagtg

SEQ ID NO: 36135 - DNA, 184 bp, Homo sapiens
ggccgggcgcggaggctcacgcctgtaatcccagctctcagggaggctaagaggcgggaggattgcttgagcccaggagttcgagacctgcctgggcaatatagcgagaccccgttctccagaaaaaggaaaaaaaaaaaaaaaaaaaaaaaaaaaaaaaaaaaaaaaaaaaaaaaaaaaaaaa

SEQ ID NO: 36136 - DNA, 230 bp, Homo sapiens
gaataatttctataagcaggaagaaaacatgacttggtcattagcctgtgaaaaaatcatgaaaacatctatggagatttaaaagtataaataaggttgtatggttctttgggaaaaagcagcagcctcatacgattaactatgtatttacagggttttccaccttcctttgtttattgtttgcttgtttgtttatattccataaaagacttgagttagctaggctaggc

SEQ ID NO: 36137 - DNA, 189 bp, Homo sapiens
  misc_feature 112: y=c or t
  misc_feature 123: w=a or t
  misc_feature 125: w=a or t
  misc_feature 128: w=a or t
  misc_feature 134: k=g or t
  misc_feature 136: y=c or t
  misc_feature 149: y=c or t
  misc_feature 160: d=a or g or t
  misc_feature 161: d=a or g or t
  misc_feature 164: w=a or t
  misc_feature 170: y=c or t
  misc_feature 177: y=c or t
  misc_feature 183: k=g or t
aaactttccaaacttttgcatgagaaactagaaaaaggaatgtatgccacgtaactggattacagaaatgagttaattgtctctgtgataaaaaaaaaaaatgaaatatttycttaattgaawtwaawattttkgycttgaagcatttyctagtgatagddtgwatttgyctttttycctggkggcact

SEQ ID NO: 36138 - DNA, 311 bp, Homo sapiens
  misc_feature 67: s=g or c
  misc_feature 124: k=g or t
  misc_feature 211: r=a or g
  misc_feature 212: r=a or g
  misc_feature 215: v=a or c or g
  misc_feature 216: s=g or c
  misc_feature 244: n=a, g, c or t
  misc_feature 245: n=a, g, c or t
  misc_feature 247: y=c or t
tacttcaattgacttccgtgcatttaactgatttgcttccgctgcgttctgtgtcgacggggcgcasagcatgcctggggccagagctcctctgacctccagaaattcattcctgcctgaaggkgtgggcctctttacatgcaggctatttctgaacaagtagcatctgggagcaagcagtgagaaagcgaggggaaaactgacaaaatcrrtcvsgcaagctcccccgagtccctttccttcnngytttctgagaactcacaatcaagccctcttgcctggtgcgcattcaccgctgttgggcctttgca

SEQ ID NO: 36139 - DNA, 65 bp, Homo sapiens
caatatgctatgtttttcctttgtggttttctgtatctatgttttatctcatttttttttttttt

SEQ ID NO: 36140 - DNA, 116 bp, Homo sapiens
agaaacggggtttcaccatgttggccaggatgatcctcaatctcctgacctcgtgatccacccgccttggcctcccaaagtgcgggattacaagcgtgaaccaccccgcccagccg

SEQ ID NO: 36141 - DNA, 102 bp, Homo sapiens
  misc_feature 70: k=g or t
ctagcagagctgtctcttcagccagtgatgagacacaggcagggcagccgggagcgctccagatggccgkggaaagtggtcgtcttgggttactgcagggca

SEQ ID NO: 36142 - DNA, 103 bp, Homo sapiens
agaaataaacggcatttgattaggaaaagaggaagtcaagttgtctctgtttgcagatgacatgattgtatatttagaaaaccccaccgtcattgcccgcccc

SEQ ID NO: 36143 - DNA, 446 bp, Homo sapiens
  misc_feature 232: k=g or t
caaatatttcgtttgtgaatgaaaatacattttgtaatttgtgaaacaaacaacccacaataccattgtgctggggccctgggtggtccctgacaccctttcagagagtccttggagtcacagatattttcaaaaaatgctaagggttatttattaacttttcttttcttgaattgatgcatattttaaaaatttctcagtttaaacatctaaaatggtaaaaatataccakatatcatccacataaacaaagctcattgatgttctcagtcatttttagcagtgtaaaggggtcctgagaccaaaaagtttgagaatggctaatgtatttcatcagcaaactaaaaacatttattaagcagctttgtattttcagtcccagtactagttgtgtagaatcggtggcagaactttgcctcacagtttagaggtgaagacatacttct

SEQ ID NO: 36144 - DNA, 55 bp, Homo sapiens
aatcttacagtctcttgggccaccctctctaccccatttctgagttttttttttt

SEQ ID NO: 36145 - DNA, 88 bp, Homo sapiens
  misc_feature 72: y=c or t
gtctttttctttccaaaaaattgcttttagatctacagatttcatcagatttgggtttgatttttttttttyccccaaaaaaatattt

SEQ ID NO: 36146 - DNA, 289 bp, Homo sapiens
  misc_feature 118: n=a, g, c or t
  misc_feature 119: m=a or c
cagcaatgcaagaatgcactaataacgaatctaggtcgggcacagtggctcacgcctgtaatcccagcactttggcaggccccaggcaggaggattacttgaactcaggagtttgagnmccagcctgggcagcataacaagaccctctccatgttggggtctctttaaaaacacacacagctgggcgcggtggctcacgcctgtaatcctagcactttgggaggccaaggcgggcggattacctgaggtcaggagttcgacacccgcctggctaacatggtgaaacccc

SEQ ID NO: 36147 - DNA, 100 bp, Homo sapiens
ttgcctgccccacttgaaaaatggggctgaccgggctcacgtgggctgacctttccacgtggcagctgtcatgctcacatcccgcactcccatgcctgcc

SEQ ID NO: 36148 - DNA, 127 bp, Homo sapiens
ccatttcaatttggtgtcccctatacatatccaaaactagcatcgattggggttgttttgaactaatgggtcttgtcctcaagcagcactattttgttcaaaataaaatagttgagagcatgcccct

SEQ ID NO: 36149 - DNA, 123 bp, Homo sapiens
atgggttctggtcacatggtgccgatgacacgtccgcctctattaaccagcgcactgacctgggcacctcttatttggacattgccaaaggcgctgtggagttattcttgaagctgcgtgccc

SEQ ID NO: 36150 - DNA, 241 bp, Homo sapiens
  misc_feature 71: d=a or g or t
  misc_feature 144: k=g or t
  misc_feature 234: k=g or t
gatcaagctggaacaggagttccgatcgacccggtaccaagaaggggagtgcccgcggcaggtaagggacdagagggaggggtttctttccgctctcgaaattgggaaaagagacagagctggggatgacctatggggtagtckgcgcgctgaaaggatgggctgggctgggacggggttcaagtgggaaaggttgatgattaaggtatagagttggacttacagatccgtttkggcgcaa

SEQ ID NO: 36151 - DNA, 291 bp, Homo sapiens
  misc_feature 44: m=a or c
  misc_feature 180: n=a, g, c or t
  misc_feature 231: n=a, g, c or t
attggtgaagttcataagaactattttgttggagtgctgcaggmcaaaagcctgattgcagggtggtgattccactgaagcaactgccaaaccaaagagaagtttttatgctgccagggatttgtacaagtaccgacaccagtacccaaacttcaaagatatccgatatcaaaatgactngagcaatcttcgtttttataagaataaaattccattcaagccagatggtgnttacattgaagaagttctaagtaaatggaaaggagattatgaaaaactggagcctcaacc

SEQ ID NO: 36152 - DNA, 383 bp, Homo sapiens
  misc_feature 158: r=a or g
  misc_feature 159: w=a or t
tttggttaagccaggaaggttagctctagggtaagtttccttgatgcaggaagagacgtaagccttgtcattgaactctcaggtggcttaccaaatagtctaaaccttaaggcagtacatctctaactttgaaaagagtaggaacaagacccttcccrwttctgcaggcctgtagtggatccaagtgtctatttctaactcccagattgttctggtgctgctcatcttcagattgcacttggagtagcaagacaggccattcaggaaaatgctattaacagagatgaatgaatctctaggccataactagtataagaaacggttttcaatgtggacatgtcctcatttttgtaaggaagtataacagaagtccaagttggtcc

SEQ ID NO: 36153 - DNA, 144 bp, Homo sapiens
caagcaattctcctgcctcagcctcctgagtagctgagactacgggcgcccgccaccatgcctggctatttttttgtatttttagtagagatggggtttcacccgagatggtctcaatctcctgacctgatgatccgcctgctt

SEQ ID NO: 36154 - DNA, 190 bp, Homo sapiens
taacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggacaa

SEQ ID NO: 36155 - DNA, 142 bp, Homo sapiens
aaattcagatttaatccttgagtgaaatgagtcactggctcatccagttaagatcatcacccactttcctaacaaaacttctcttcaaagaaggactcgctcatccatcaggtggacctccacaggaacaaatcatatccat

SEQ ID NO: 36156 - DNA, 193 bp, Homo sapiens
  misc_feature 128: w=a or t
  misc_feature 169: k=g or t
tagtcagagattgtatgaattagtccctttccaggctcaaagttcttacacatgaagtgagtgtgactagacttcagatctccaaaacctcaccaagaacaatccatggagctacaattgcctctgcwtaaattcttgggacctgaagattctaatttgcacacttgaktgagttatacctaccctggccttt

SEQ ID NO: 36157 - DNA, 147 bp, Homo sapiens
cgcttttcctaaacaaagtttttacaccacgtacaatctgaatagacacgcaactttaaaccagctagtgttacagactctaaagtagaggcataatcttctagatcagaatctggattggaagtgggataaagaaatcttgacccc

SEQ ID NO: 36158 - DNA, 471 bp, Homo sapiens
  misc_feature 151: y=c or t
gttttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgyggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaaacaagaaagctggtgcaggagctgttgctgtgttctgcagagctgagc

SEQ ID NO: 36159 - DNA, 229 bp, Homo sapiens
  misc_feature 134: m=a or c
  misc_feature 135: m=a or c
  misc_feature 217: y=c or t
tttggtagagatgaggtcttgctatgtggcacagactagtcttatactcctggcctcaagtgatcttcctgccttggcctctcaaagtgctgggattacaggtgtgagccactgcacccagcctaaatgttaammtacattggcataaaatttatactgggcccagttgatttctctgcccagattcatttggctcccttctcaaacctcagttgcytgtcctacttcc

SEQ ID NO: 36160 - DNA, 424 bp, Homo sapiens
  misc_feature 130: y=c or t
  misc_feature 132: n=a, g, c or t
  misc_feature 133: n=a, g, c or t
  misc_feature 313: s=g or c
ataattcctttgaaataattatttttggcaaaaagatcaataacgaaggtgatgtcagtgtgaggttggatggggagttcctgggtagatgtccttgcacaagtattttgttgtgtaaggctgtgatggycnntgtgcaagagcgtaggtttttagagtcctttgtgatagttgtgttatcaggcattcaagcgtgagaaccctctcttcatggccttccctgtctgtttgtcaaaggtttttggttttgtttttttaatattagtgactccattttgattctgaagttccttatgctgaaatctgtatgatstttttctatgttttaggctcactgataaaacccttatagaaagcttttttgagagcaccaaaattgtctgggtaccttcttaggtgtgagactgagctctctccatggctc

SEQ ID NO: 36161 - DNA, 382 bp, Homo sapiens
tcatttgatcttcacagattactataaaagggattattttgcgttctttaccaccaagcaaccaaagcctctctcccccggcaaataattttccaacactcactaacatcaaaacactctacagattcaataaactttgattctcatttcctttcctgagttctataggctgaaactctggcctcttttttgcttagtccatttgtattacattacaagacttgccgtatactatctttgtatggatttaggtattcgaagcagcctttgaacttcttatcctttgctttgtttctttctgcactggccttacattctctgctcttttccctgccctttccatgtcttctttgccgccctctcgacacctccccctacccct

SEQ ID NO: 36162 - DNA, 160 bp, Homo sapiens
acaactagagatgagtagatgtatttgcttttttgccttttattttcccagggcttttagaaaacacttttattttgaaataattatagattcacaggagattgtaaagaggtgtacaggagagtcccatgaattcctctgctggtcttccccccatggc

SEQ ID NO: 36163 - DNA, 190 bp, Homo sapiens
atctagaaatgtgtatataatacaagagggggtgactaggcctttcagttggtggcaggtggatattgatggaggaggtgggtatgcacatgtgggagtggtgcatgaagagaagcccacacaggcaggcaccgggccagaagaggggagtgctggggtatttgggaccaagtggtggtatggctgcaac

SEQ ID NO: 36164 - DNA, 119 bp, Homo sapiens
aatgagatggttaaaagttttaattatatttctctgaaccttttaataagtgtttaccacctctattttctgttttctgaactttgtgtctttttcttttctttctttttttttttttt

SEQ ID NO: 36165 - DNA, 66 bp, Homo sapiens
  misc_feature 5: y=c or t
  misc_feature 17: k=g or t
  misc_feature 21: w=a or t
  misc_feature 33: k=g or t
  misc_feature 44: k=g or t
  misc_feature 49: w=a or t
ttggygttgtgacgtgkgccwgtagtcccagckactcagtccckgcagwcccagctactcagtccc

SEQ ID NO: 36166 - DNA, 217 bp, Homo sapiens
tgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcggc

SEQ ID NO: 36167 - DNA, 331 bp, Homo sapiens
tgaaaatattttataatggagattgcaactttcagttatgagttatttgaaaaaaatatatattcacttggtaacctttaggggaaaaaatagtataaattgttcaatatgctactaatattgggttttttaaataattaaactctatttttattaccagaatctgtctttaactgtttaaaaagacaaagaaaaagaaaacttggctctgcccttagcacccagtaatcattcacctttaatgcaagtaatttcagtgctaagggcaaactcttgtgtttgctgatgatgctttaaagataatcatgccaggaaaactagaaaagctcgc

SEQ ID NO: 36168 - DNA, 138 bp, Homo sapiens
  misc_feature 110: n=a, g, c or t
ctgagcatttggaaaccttgaagggtttgtggaaagatcattggtgagacagtgtcaagtgaaaagaagaaaaggccttgggatctattatttatttttattggccaagnagagcttaccctatttcttttttttttt

SEQ ID NO: 36169 - DNA, 222 bp, Homo sapiens
ttcctgtcttaattttctctcataaaaggaaaagatttgatattcctgagtcatcactctcctgaaatctcagttttactcagacctgtgctatatagagtattatgttcatgcccatgtctgatgtggagggagagacacagacaggagagtgggtgactgactcagatgtaaatgatcttattatacttgagctgcaaccacacctagaaaccttgacat

SEQ ID NO: 36170 - DNA, 88 bp, Homo sapiens
  misc_feature 16: k=g or t
  misc_feature 23: k=g or t
  misc_feature 66: w=a or t
aattggactgtggcaktagcatkaactattttaagcacttggccaggctcggtggctcacgcctgwaatcccagcactttgggaggcc

SEQ ID NO: 36171 - DNA, 176 bp, Homo sapiens
  misc_feature 122: k=g or t
  misc_feature 149: w=a or t
aattgaacgtctgtcttggatattggcttgagcttagatatggcaattccaccagtgattatttcagtgattgtgtgaattgttagaattaagataatttggtgttaattgcagtgattatktcaagttataagattgtaatctattawaaacgtgttaaggatggaaggcacaac

SEQ ID NO: 36172 - DNA, 142 bp, Homo sapiens
  misc_feature 3: w=a or t
  misc_feature 71: m=a or c
  misc_feature 97: k=g or t
  misc_feature 120: r=a or g
  misc_feature 122: n=a, g, c or t
gcwaaatggctgtgcagaaaagcatgcgggatctgcccaagcggggcagcggctgagggggccctggatamcttccccatctcttgctgcctcctgkccagatcgggggagctggagtgrangctggctgtcaaatatccga

SEQ ID NO: 36173 - DNA, 115 bp, Homo sapiens
  misc_feature 65: k=g or t
  misc_feature 77: y=c or t
  misc_feature 78: w=a or t
gttaaattgacgattggacttccaaaacaggccatttcatttttcattttttaacagcatgcttkaacaacagtgaywttggatcttagcaagctcataccggtggagcaagttc

SEQ ID NO: 36174 - DNA, 61 bp, Homo sapiens
  misc_feature 15: s=g or c
  misc_feature 16: r=a or g
  misc_feature 48: k=g or t
  misc_feature 50: k=g or t
tcactacttggtaasrtcaccattaccaccttctgaatctcccacttkckaagtctactct

SEQ ID NO: 36175 - DNA, 69 bp, Homo sapiens
  misc_feature 14: k=g or t
  misc_feature 15: w=a or t
  misc_feature 42: y=c or t
ttgtagccttctgkwatagtttgaagtcaggtagtgtgatgyctctagctttgttattttggcttagga

SEQ ID NO: 36176 - DNA, 261 bp, Homo sapiens
  misc_feature 11: y=c or t
  misc_feature 21: d=a or g or t
  misc_feature 57: k=g or t
  misc_feature 73: w=a or t
  misc_feature 110: w=a or t
  misc_feature 112: k=g or t
  misc_feature 113: k=g or t
  misc_feature 129: k=g or t
  misc_feature 145: k=g or t
  misc_feature 146: w=a or t
  misc_feature 159: r=a or g
  misc_feature 168: w=a or t
  misc_feature 211: w=a or t
  misc_feature 225: w=a or t
  misc_feature 231: v=a or c or g
  misc_feature 232: s=g or c
tctccttgtgytaagtatttdacatacgttatgtcattatgtgtgtacatttccatkcaaccctatgaatggwtgtttttagtttttatctctgttttatgtataacgawakkgatgtgcagaaatcakatgaattagatgtttkwatgcgcactcgarcttaccgtwtctttttcaccacctgtatcgctaatcctcttaactggcaggwatggggcaagtcawtttcavsacgcgagtcttaggctaaatctgtttata

SEQ ID NO: 36177 - DNA, 116 bp, Homo sapiens
ttagctttctttccgtctgtctcaacagctgagatggggccgccaaggagtgccttccttttgctccctcctagctgggagtgacgggtgggagtgtgtgtgcccaggtgggggca

SEQ ID NO: 36178 - DNA, 325 bp, Homo sapiens
  misc_feature 163: d=a or g or t
  misc_feature 164: d=a or g or t
ttaaactagaatttaggcatcaagaacactcttggctgggcacagtggatcatgcctgtaatcccagcactttgggaggccgaggcaggaagactgcttgagcccaggagttcaaaactagccttgtcaacacagcaagtccccatcgctacaaaaataataddttagccaactatggtggtgcatggctgtagtcctatctacttaggaggctgaggcaggagaattgcttgagccccggagttccaggctgcagtaagctatgatcacactactatataccagtatgagcaacagaacaagaccttgtctttattttaatttt

SEQ ID NO: 36179 - DNA, 267 bp, Homo sapiens
tgtttacaaaagtatcttgaatttgatagagcttatgttgagaaataatttttaatcttttaattccatttttccatgaactttttgaagtccccgtatacatactttttcatggtgagaacacttataatctactgtcagcaattttcaaatataaaatatattattaactgtagtcaccatgatatacagtagatctcttgaacttattcctcttttgtctgaaattttgtatgctttggccaacatctccccaatcccccagac

SEQ ID NO: 36180 - DNA, 360 bp, Homo sapiens
  misc_feature 189: n=a, g, c or t
  misc_feature 199: r=a or g
tgaggagtaagcttgtaatgtatttgtgcaactgcttctttctgtaattctaagcaggagcaagcagtaaactaattttcagatttcagaaaagtccatcagtgcaggcagagcttcctttttgtttcctgacaaatagtttgttgacactgaaaacaaaagatgtgttttctggcactgtttcaggcnttctttttgrgaacaagctgctctgtggatgtgttcagtttctactatttcaaagtccagtgggtggcatttacatgggttttaaactatctttagttattaacattggtgttattattggtaattattcatgatagtaatgcttagtgagtatctgggtatacagggcac

SEQ ID NO: 36181 - DNA, 118 bp, Homo sapiens
  misc_feature 104: m=a or c
agatgaagccaccctggcccgtctggatctggagaggaagattgagtcgctggaggaggagatccggttcttgaggaagatccacgaggaggaggttcgggaamtccaggagcaggcg

SEQ ID NO: 36182 - DNA, 300 bp, Homo sapiens
  misc_feature 105: m=a or c
  misc_feature 206: n=a, g, c or t
ttttgagttaacttggttatctgtattaagcaaaaacacaggcagaacattttattcctttgtttttcttactgcctgcctcaagtgaaaggtagatatgaaaamcttgacttgaatgaataaaacatctggactacaaattattacccagaagttcagcttctctaatatatttcgattcctctctgtcctgcatgtagaagccnagtgcaaatgccttaaaagtaattctaggcatagctgttaatttggtttcctaattatttagttttacattcacacaagtagccaatgcatacc

SEQ ID NO: 36183 - DNA, 148 bp, Homo sapiens
  misc_feature 106: r=a or g
gaagattggaaatttggaaaaagaaaacaaaaccctatccaaagaaattggtatatataaagaatcttgtgtccgtctgaaagaactagaaaaagaaaataaggarctttgtgaaaagagcaactattgatataaaaacgttggtatc

SEQ ID NO: 36184 - DNA, 344 bp, Homo sapiens
  misc_feature 105: n=a, g, c or t
  misc_feature 332: w=a or t
ttaggaaagttgaaaatctaagattttgagaaactgaaaaagaaggcggggcacagtggccggcccctataatcccaacacttcaggaggcctaggtgggcggantgtttgagttcaggagttcaagaccagcctgggcaacatggtgagactctgtctctactaaaaatacaaagaaatagccaggcatggtggtgtgcgcctgtggtctcagttacttgggatgctgagatggggggattgcttgagcacagggagcagaggttgcagtgagccaagatcttgccactgcactccagcctggtgacagagcgagaccctgtcccaaggawaaaaaaaagaaa

SEQ ID NO: 36185 - DNA, 198 bp, Homo sapiens
  misc_feature 48: r=a or g
  misc_feature 88: m=a or c
gacccacagaatgagcttcggggaggcagggccagagaaccacccagrcaaaacaaacaaaacaataagcccagcaacatggagggamagaaacagggtctcactacattgcccaggctggtctcgaactcctgaactcaagtgatcctcccacctcagcctcccaaagtgctcggattacaggtatgagccacccaa

SEQ ID NO: 36186 - DNA, 94 bp, Homo sapiens
ttcagtttcgcattcagtgacacccaagctttgaatctgtgaagtagactagcccatttaatatgccaattaaaaatggattgatctactttga

SEQ ID NO: 36187 - DNA, 324 bp, Homo sapiens
  misc_feature 112: y=c or t
  misc_feature 276: v=a or c or g
  misc_feature 277: n=a, g, c or t
  misc_feature 309: b=c or g or t
ctactcgggaggctgaggcaggagaattgcttgaacctgggaggcggaggttgtagtgagcagagatcgcaccattgcactccagcctgggcaacaagaacgagactccggycttcaaaaacaaaacaaacaacaacaacaaaaaaacagcctcccgacccccaggcctcacaaagctcctcactacttgatcccagccccggtcttctcccgaggccctctgcacaggcacgactgcttgtggagactcgttgtctcctgccagatcttaggccvntggagggcgaggcctgggcttctcacacgtcbaccattcccataccg

SEQ ID NO: 36188 - DNA, 231 bp, Homo sapiens
  misc_feature 34: w=a or t
  misc_feature 118: m=a or c
tacaaaaattagccaggcgtggtggcatgtgccwgtaatcccagctactagggaggctgaggtaggagaattgcttgaacccaggagacggaagttgcagtgagctgagatttgtgcmactgtactttagcatgggcaacggagcaagactctctcaaaaaaataaataaataagagagaaagatagtggtggggttggagaaagtaagatttttttttaatgaggtggaa

SEQ ID NO: 36189 - DNA, 142 bp, Homo sapiens
atactaaggctccttcagctaacagaccattacttctcctttgctttcccccttctcctctcactgcctctcttctgtcagcatctcatttcatcagtttgtgcgtcttatttcatgaaaccaaactgtgagaagatgctga

SEQ ID NO: 36190 - DNA, 447 bp, Homo sapiens
  misc_feature 303: k=g or t
  misc_feature 304: n=a, g, c or t
  misc_feature 418: n=a, g, c or t
  misc_feature 419: r=a or g
  misc_feature 441: y=c or t
tgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttckntaaatttggattttggtatctttggttttgtagttgactgcagtgtgatgtgaccttacctttataagagccacttgatggagtagatctgtcacattactaagatacgatatnrctttttttttccgagacggagyttgctc

SEQ ID NO: 36191 - DNA, 208 bp, Homo sapiens
  misc_feature 176: r=a or g
tatgcatatgactcatcaatatatctgtatttccatatagaaagaacacttagaccgggcacagtgactcacgcctgtaatcccggcactttgggaggccggggctggcggatcacttgaggccaggagttcaagaccagcctggctaacatggcgaaaaccctgtcactactaaraaatacaaaaattagcctggtatggtggcgca

SEQ ID NO: 36192 - DNA, 92 bp, Homo sapiens
  misc_feature 87: m=a or c
ccatccacaagtttcaggggaatccccaaggccacgcacatttctgtccagctggttactaattgtaggaggttcccatgtccccamcttca

SEQ ID NO: 36193 - DNA, 198 bp, Homo sapiens
taattcttatgtcctaattttatttaattctgagttccttacacagcattttagggaaagaatacaggcaggatgacactttgtgttaaagtgttatttttatgtattacctggaatgaggcaggtttttttctgttttctaaaaagagtaaccaagatacctccagggtgtcattgggttccagctgctctcctcca

SEQ ID NO: 36194 - DNA, 54 bp, Homo sapiens
atagcgctcggagcgctcttgcggccacaggcgcggcgtcctcggcggcgggca

SEQ ID NO: 36195 - DNA, 140 bp, Homo sapiens
  misc_feature 108: w=a or t
  misc_feature 110: k=g or t
ttaaaattacatcatgaagcagttataatttcccccattttacaggatcaaagaaattgaggtttagggagacatgattagtaagtgccagagctaagatttacatawgkttttaactgacctcagagccaggacgcgga

SEQ ID NO: 36196 - DNA, 204 bp, Homo sapiens
  misc_feature 113: w=a or t
tgcccattactgtgagggacccttgaagtctggactcttaaatgggtttttgctgatttcctgggtgcatgctaggatgatggggcttgatgcagtagggaaagagacctttwaaataattttgctataaaaaaatttgtgataagtttctatcaaaatggggagattgcagaaaaggcttcccttggctcccaaggaggtgca

SEQ ID NO: 36197 - DNA, 448 bp, Homo sapiens
  misc_feature 15: w=a or t
  misc_feature 16: k=g or t
  misc_feature 112: r=a or g
  misc_feature 144: n=a, g, c or t
  misc_feature 145: w=a or t
  misc_feature 241: k=g or t
  misc_feature 411: d=a or g or t
  misc_feature 447: w=a or t
cacttggacacttgwkgccatgctgggttattaattggcctaatttcagtatcattgtgtctcagggaatagagacactcaagagcagaaacataaatgggggaactactgrtcagtggagcagcccgtgcacacacaacattnwtcgattaagtttgcaatcgtatatgagtatgatttgtgctgctcccaatcaattgcaatgctaacatcaaagatcactaatcacatatcaccatakaaatataataataatgaaaaagtttgaaatattgtgagaattaccaatatacgacatagtgacatgaagtgagaatgtgctgttggaaaaatgacagataaacttgttcgatgcaggattgtcacaaacctttaatttgtggaaaaggtaatatctgccaagctcaatadagcaaagggcagtaaaacaggtatgcctataccatwa

SEQ ID NO: 36198 - DNA, 264 bp, Homo sapiens
  misc_feature 112: w=a or t
tcaataaaaataataaactacaagtaaatgcaacaacatgtatgcatctcaaatacagtatatttttgtggagagaaagacaccaaagagtacatactatataatttcattwatatgaagttcaaaactaggcaaaattaacctgtgttattacagaaaacaatactaattgcctatgagtattggcaggaaggggcatgagagagctttgtgggatggcagaaatgctctacattctgatgggagtgttggtttcagggggac

SEQ ID NO: 36199 - DNA, 120 bp, Homo sapiens
  misc_feature 112: r=a or g
  misc_feature 113: m=a or c
aacgccccgggcagcttggctggggctaggcttccggggctctgcagtcctcggcgtgtgctggcagcttcggagcccaccgagccgggcggctaggatgatgaaccggacrmcccccga

SEQ ID NO: 36200 - DNA, 212 bp, Homo sapiens
  misc_feature 126: n=a, g, c or t
ttttaagaaggataattttccaaaacctaaatgctacacattttacagtggcaatatcaaccttatcatgagctaaagatttgcaatcagaacattggtagagtgcattgctgagttataacaacngtctcaggacgaggatatttggtaggtatccttaaatatatagatgcttaccagtaggtttaatagaagatttctgaaaggtagcg

SEQ ID NO: 36201 - DNA, 202 bp, Homo sapiens
cagtttcccacatccttgctaacacttgttattatctgtctttttaaagtttagccattctattggttgtgaagtggtatctcatagtaggctaagtttcaaaatagcagttaggcataacaggagtgatagtactttaagatgaagttaatgttccaattaaaatattgaataggctgacctaggaatggttcttgaccct

SEQ ID NO: 36202 - DNA, 313 bp, Homo sapiens
  misc_feature 106: s=g or c
  misc_feature 114: r=a or g
ttgactagccaattttaaatgtttcttgcatggttccatttacagggaaatgacagaaaaatgcgaagagagaggtaaaacaagagggaacactcttaaacactgscggtgggraaggtaaactagtacaaccactatggaaaacagtatggagatttcttagagaactaaaagtagaactaccattcgatccagcagtcacactactgggtgtctacccagaggaggagaagtcactgtatgaaaaagatgcatgtacatgcatgcttatagctgcacaatttgcaattgcaaaaatatggaaccagcccct

SEQ ID NO: 36203 - DNA, 349 bp, Homo sapiens
  misc_feature 95: y=c or t
  misc_feature 96: w=a or t
  misc_feature 193: n=a, g, c or t
  misc_feature 331: d=a or g or t
  misc_feature 332: b=c or g or t
  misc_feature 333: b=c or g or t
tttttccatggtctccctctgatgccgagctgaagctggactgtactgctgccatctcggctcactgcaacctccctgcctgattctcctgcctywgcctgccgagtgcctgcgattgcaggcgcgcgccgccacgcctgactggttttcatatttttttggtggagactgggtttccctgtgttagccgggntggtctccagctcctaaccgcgagtgatccgccagcctcggcctccggaggtgccgggattgcagacggtgtctggttcactcagtgctcaatggtgcccaggctggagtgcagtggcgtgatctcggctcgctacadbbtccacctcccaggcca

SEQ ID NO: 36204 - DNA, 367 bp, Homo sapiens
  misc_feature 103: r=a or g
  misc_feature 111: k=g or t
  misc_feature 112: r=a or g
  misc_feature 113: d=a or g or t
  misc_feature 119: w=a or t
  misc_feature 124: n=a, g, c or t
  misc_feature 128: r=a or g
  misc_feature 157: n=a, g, c or t
  misc_feature 323: d=a or g or t
cgaaataagttttctggtgattcaaacaccagttcccctttgtaagatttcctaatcatagagataatctaagaaaccaaattagtgtggaatctttgcagaragagaatkrdtttgawtgtantcargcaggggacggagaaagaatgctagaatnctaggggaatgcacatgccagtaccccagtcagtattactctccaattctgtagaatccacagttgcatgtcattgttcaacatgcattgcaatgtgtgggccaagtttgctacttatcaactaaatgcattttatagtacttaccatgttttgattttttttttdaatcacatcaataatgtgtctccaaatgactttgtaagggggct

SEQ ID NO: 36205 - DNA, 289 bp, Homo sapiens
  misc_feature 104: m=a or c
  misc_feature 115: w=a or t
  misc_feature 119: h=a or c or t
  misc_feature 120: m=a or c
  misc_feature 128: w=a or t
  misc_feature 129: w=a or t
  misc_feature 143: m=a or c
  misc_feature 144: m=a or c
cgtattctgcatgagagggagaaactgaatgctatgagccactgtatgaaagtgctttatttgtgctgttgataagagcacatgagctcatttcacgtagacamcttctcctggwtgghmatttcgtwwgataagtgccccammaaggcctggttctactaagctcagtggttcatgaccaggaaaagatgcagccctgagttgagtgaatatgctgtgccaataccctaagtccctaaaacagaatgtagacaggaaaagagaaatgcttttctgcaaatagcggcaa

SEQ ID NO: 36206 - DNA, 217 bp, Homo sapiens
  misc_feature 58: w=a or t
  misc_feature 63: y=c or t
  misc_feature 96: w=a or t
  misc_feature 117: d=a or g or t
  misc_feature 125: k=g or t
  misc_feature 128: k=g or t
  misc_feature 130: m=a or c
  misc_feature 144: w=a or t
  misc_feature 149: w=a or t
  misc_feature 176: w=a or t
cttctcttttatagctttatttagttttatagatttaaccactttttttttatacttwatgtyctgggatacatgtgcagaacgtgcaggtttgtwacacaggtatacatgtgccadggtgattkgtkgmactcatcaacccgwcatcwaggttttaagccctgcatgcactaggwattggtcctaatgctctccctccccttgcccctgacccctt

SEQ ID NO: 36207 - DNA, 362 bp, Homo sapiens
  misc_feature 16: b=c or g or t
  misc_feature 17: w=a or t
  misc_feature 207: n=a, g, c or t
  misc_feature 208: n=a, g, c or t
  misc_feature 209: d=a or g or t
  misc_feature 210: w=a or t
cagaatttaaaagtabwggttcttagggatagactttataagaaattagatatttgcatttttgacacattttgaggcagtaattttaagatatgtctgtatagctgatggatgcttattttacatgaatgtgttgaaggttacaaactcttaaatttaacattaaactacttttattattcctgtaaagctgtgtttactaaccanndwcatgtagtggcacatagagaaaattgtatataatattacacactgtggtaagtgaatcagcctacggttcttgatctcaagtaattggcctagggacctaccacctctttaccttcatgctctgcttcccctccctacttactccctcctct

SEQ ID NO: 36208 - DNA, 77 bp, Homo sapiens
  misc_feature 9: y=c or t
  misc_feature 10: w=a or t
  misc_feature 16: b=c or g or t
  misc_feature 30: h=a or c or t
  misc_feature 41: y=c or t
  misc_feature 74: w=a or t
agaacaagywgtggcbcacccaactatgchgcaccagaagyaatttcaggaagattgtatgcaggcccagaggwaga

SEQ ID NO: 36209 - DNA, 309 bp, Homo sapiens
  misc_feature 108: m=a or c
  misc_feature 269: n=a, g, c or t
taattacaattaactttagagaagcttgcaatttataacatgtattggggaatctaggacaggcaaatcttgtgtcctcaaaggggagtctttaaaccacagatttamcaaatacaatgcaatatgaaagagactgtccccagagaccttggtcctcactcctgtcctgcagagtctaggcctgctcacttttgctgctgggagttgtcctggatcaggaagtgaatagtctctttgagagccacatttttaaagagtttgggattatnggtacagttttttagcatggattttttttttttttttttt

SEQ ID NO: 36210 - DNA, 164 bp, Homo sapiens
  misc_feature 111: k=g or t
  misc_feature 117: m=a or c
cagatgtacgctgttgaccttaaacttcttttctgggttccaaatttcaacctccctcatcagatctctaatcagaagtgggcagagaggcctcatatcttttccagttgkccaacmgtgaacctctaacttccatctcagacatctttattgtaagatgaatt

SEQ ID NO: 36211 - DNA, 325 bp, Homo sapiens
  misc_feature 116: k=g or t
  misc_feature 117: b=c or g or t
ttatacttttagattttacatttaagtctttaatccatgtcgagttgatttgtgtatatggtgaaaggtagggatccagtctcaatattctacttgtggctagccagttatcccakbacgatttattgaatagggagtcctttccccagtgcttgttgttttcaactttttcaaagattagttggtggtaggtgtgcacctttgtttctgggttttctgacttgttctattggtctatgcatcagtttttgtaccagtaccatgctgttttggttattgtagccttgtagtatagtttgaaatcaggtagtgtgatgcctctggc

SEQ ID NO: 36212 - DNA, 264 bp, Homo sapiens
  misc_feature 114: m=a or c
  misc_feature 117: w=a or t
taggagctcattgcagtcattatttttgtaagagacgagggcctgaaccagtcgttggtggcaagattgcttttgagagagatccccaaagcccaaagggcagggtttgctgamtgwggcacctagaggaggagatccaaaaggatgattctgaggtttctactgcaggcacccaggtgatggtgaatctgttaaccgagacaggggagcaaattcgaagtgcctgtcaggactttcacaaggagttattcagcaggagacacc

SEQ ID NO: 36213 - DNA, 292 bp, Homo sapiens
  misc_feature 115: m=a or c
ccttgaaaactttttaggccaggcgtggtggctcatgcctataatcccagcgctttgggaggctgaggtgggagcatcgcttgagcccaggagtttgagaccagcctgggcaacmatggtgaaactctgtctctacaaaagacacaaatattagacaggtatgatggtgtctagtcccagctactcgggaggctgaggcgggagaatggcgtgagccgggaggtggagcttgcagtgagccaagattgcgccactgcattccagcctgggtgacagagccggactccgtctc

SEQ ID NO: 36214 - DNA, 163 bp, Homo sapiens
ttatatgcaatgggaaacaaaaaaatgtgtgtgactcactctattgtgatattcagtttactgcagtgatgtggaactaagcccacaatatccctgcagtatggctgttacagtataagaatcacctgaagggcttattaaaaacagcttgcttgacccccta

SEQ ID NO: 36215 - DNA, 220 bp, Homo sapiens
  misc_feature 116: w=a or t
  misc_feature 130: d=a or g or t
  misc_feature 164: v=a or c or g
  misc_feature 179: m=a or c
  misc_feature 197: k=g or t
caaatgaaatggaaattggtaaatggacaaaagctagctagtaaaaaggacgacccagcaacatgctttaaccccattgtatgtttgtggaaagagcatagtttaacatcttgagwaatttgggacatadagttttcatggtagacagttcatgcagtatatgvattgacataatggamataatctgattttatttktacaactaacatccattcccctt

SEQ ID NO: 36216 - DNA, 71 bp, Homo sapiens
  misc_feature 25: k=g or t
cattcagcagcacccactgtgcctkctgtagcacttccatccacctgacagtatgtatctttgttacttcc

SEQ ID NO: 36217 - DNA, 82 bp, Homo sapiens
ctctgttcttttctctccgcggtgtgtgtgtgcgtgcgcgcgtgtgtgttttcttcttctcctcctcctctccccgagttgc

SEQ ID NO: 36218 - DNA, 146 bp, Homo sapiens
  misc_feature 16: d=a or g or t
  misc_feature 108: r=a or g
  misc_feature 138: r=a or g
taaatatacttaaatdtacaatgttgttacccgtaattttccccctgtgctattgaatactagaacttatcccttctatttaactgcatgtttgtgcccattagccarcctctctttatcccccttcccacccacacrcacctcct

SEQ ID NO: 36219 - DNA, 135 bp, Homo sapiens
  misc_feature 4: m=a or c
  misc_feature 16: r=a or g
  misc_feature 129: w=a or t
tcgmccaatttttccrgatctctgtttgtggtgaggtgtaattatgtgtgtttttcctagcttagtgtgtgcgttctttctttttgtttctgagaatgctgtgttgagggggtttttggagaaaacggwggggtt

SEQ ID NO: 36220 - DNA, 385 bp, Homo sapiens
  misc_feature 138: n=a, g, c or t
  misc_feature 266: m=a or c
  misc_feature 268: n=a, g, c or t
  misc_feature 273: w=a or t
  misc_feature 277: w=a or t
  misc_feature 297: r=a or g
  misc_feature 308: w=a or t
  misc_feature 313: w=a or t
  misc_feature 320: n=a, g, c or t
  misc_feature 321: n=a, g, c or t
  misc_feature 331: w=a or t
  misc_feature 352: k=g or t
tgaaacatgtacatgtctagtgttgcatttttttttcttttttaaactaaattctgtgtttgtgaataaatgtcagtgctcttggtttacttgctaaaattctagaagttagttttcagaactgttccagatacacangcctttaactggtgcatgttctgtgatatgtaggacctgttgaaatttaagcagtaaactctagctcccattattttgaagagtttttcctcatttcagtttttttttttccccaaaaatcagaggamantttgwattwattttgatttgaaatactgrgcaagctagtwatttwaaatctnntttccccgtwagagcattttggagaacctgkggtcaaattccaccaaattgtcttcaaaattgt

SEQ ID NO: 36221 - DNA, 92 bp, Homo sapiens
aagactatactttcagagatcatttctatagtgtgttactagagaagtttctctgaacgtgtagagcaccgaaaaccacgaggaagagaggt

SEQ ID NO: 36222 - DNA, 476 bp, Homo sapiens
  misc_feature 86: h=a or c or t
  misc_feature 87: n=a, g, c or t
  misc_feature 88: n=a, g, c or t
  misc_feature 204: k=g or t
  misc_feature 216: b=c or g or t
  misc_feature 217: w=a or t
  misc_feature 427: m=a or c
  misc_feature 451: r=a or g
ccctaaattatttatgtatatcacagatttatgcatataatacaaatagtcatacattccatatctgttaacttatggtggtttthnnggggtgctttaagtactttatttttattaaaatttttcccctactttattgagatataattgacaaaatcatataaatgtatatgtaacatgatgatttgataggcaaatatattktgaagtaattabwgcagccaagttgcttaacacttccatcaccttttaatagacattttagtattttaagtcgctagttttcaactgggatgaatttacccccagggaacatttggcaatgcctggagctggagacattttaggttgtcacagctgggaagggggtgctactgacatctagtgggtagaggccaggagtgctgctaaatatcctgcagtgcamaaggacaagcctgccacaacagaraattttctggtgcagtatgtcacta

SEQ ID NO: 36223 - DNA, 174 bp, Homo sapiens
caagaaaagaagagagaagatccaaataagctctattagaaatgaaatgggagatattaccactgataccacagaaatacaaaagattattcaagactactatgaacatcttcacatccataaactagaaaacctacaggagatcgataaattcctggaaatatacaaccctct

SEQ ID NO: 36224 - DNA, 220 bp, Homo sapiens
catgtctgattcatcatacttatattttgcaccttcttaccttcttctgttattaatttgttgctttttcaacttatattttagattgagggtacatatgcaggtttgttacatggtatactgcatgatgctgaggtttgcggtatgattgaacctgtcacccaggtagtgagcatagcacacaacaggtagcttttcaactcttgcccccctctctccc

SEQ ID NO: 36225 - DNA, 149 bp, Homo sapiens
cggtttgaaagggaagagacaggacctggtagggtttgagaacaggaatacacagaaggttcatacagttggatttgggggcccattcccctcaggctcacctgttactcggcctcccagaaagatggataggagaaatgactacggca

SEQ ID NO: 36226 - DNA, 78 bp, Homo sapiens
  misc_feature 8: y=c or t
  misc_feature 13: k=g or t
  misc_feature 22: y=c or t
  misc_feature 33: m=a or c
  misc_feature 47: k=g or t
  misc_feature 49: y=c or t
  misc_feature 60: y=c or t
ttcgtttytaackggaacattyagaaagaaggmaatgaatgtgcatktyattaattcctyaggggcacaaggaggaca

SEQ ID NO: 36227 - DNA, 141 bp, Homo sapiens
cattgcagtcattccctaagtttcttctcttttttttcatggctgctagtattttattttagaatcacagactctcagcttagagagtcacagtatctcaattatttgctctgttcaatacttaacaataccccctcactc

SEQ ID NO: 36228 - DNA, 98 bp, Homo sapiens
  misc_feature 73: r=a or g
atccacttctagggttaagcaatcactgcattgcgggtggtgcttagtgtgtgcctcagtctgtcagacagargccagtcctatagctccaatatgtt

SEQ ID NO: 36229 - DNA, 172 bp, Homo sapiens
  misc_feature 58: r=a or g
  misc_feature 119: h=a or c or t
  misc_feature 122: r=a or g
  misc_feature 172: s=g or c
taggagttgagaccagcctggccaacatagtgaatccccgtctctactaaaaatacaraaaattacctgggcatggtggcaggcgcctgtgatcccagctactcgggaggctgaggcahggrgaattgcttgaacccgggaagcggaggttgcagagagccgagattgcgcs

SEQ ID NO: 36230 - DNA, 142 bp, Homo sapiens
catactgtttttatttttctttaatggactttattaagatatatattcagtgaattgcacctgtttaaagtatacattttaattttggcaaatgtaaccaccaccacatcaagatacagaaaacttccaccaccccccaata

SEQ ID NO: 36231 - DNA, 70 bp, Homo sapiens
  misc_feature 4: m=a or c
  misc_feature 12: w=a or t
atgmataaagawaatatgagatatatatatatatatatatacatacatacacacacagtggaaaattata

SEQ ID NO: 36232 - DNA, 206 bp, Homo sapiens
  misc_feature 52: m=a or c
  misc_feature 53: m=a or c
  misc_feature 113: b=c or g or t
  misc_feature 114: w=a or t
  misc_feature 122: r=a or g
  misc_feature 136: r=a or g
  misc_feature 165: k=g or t
caagaaattaaaaaggttttaggagctgtgtgccaaaaactaggggtagagmmctatatctatctcttattatttctcacacatgctcatatacaagcatgtatattattaabwtgaaggaraaataagatgatarcccacatacagtgttagtcattcactctkacacaccgttggaggaacaggtataacatttactctcacac

SEQ ID NO: 36233 - DNA, 169 bp, Homo sapiens
gcggtcagggctggccttggcttcagctgcggttttggggtcccggactctgggatcggcagcgctatgagttctttcgaggggcagatggccgagtatccaactatctccatagaccgcttcgatagggagaacctgagggcccgcgcctacttcctgtcccactaaa

SEQ ID NO: 36234 - DNA, 227 bp, Homo sapiens
ataagtaggttgaagtattctgtaagcagttaggcataagggtctgagcttctgaaacaaatttggacgttagttgaaagcatataaatgggtaagactcttcgggataagtgaagaattggagacagggaaacagtccagctggactcgcagatttagagatgggcagtggcatgggggagcaggataagaaaagtcggcgaggtaagaagaaaaacagggcaact

SEQ ID NO: 36235 - DNA, 240 bp, Homo sapiens
  misc_feature 142: w=a or t
  misc_feature 152: v=a or c or g
  misc_feature 201: w=a or t
  misc_feature 203: b=c or g or t
  misc_feature 204: r=a or g
attccacgcttcagcggaccagcctccccgcgctcccggagaagggggtcggcgacgcggaggcggggtgggggccgtaggggatggaaccgaggcgcgcgcgagaagagccgaggaacccaagtcagaaccatggctccawaacaaaagavaaagacatcacgtggcaaaaaaagactaaaaccagtattagctggtcawcbrgaaatttatcctttagtattaaccaccaagccccat

SEQ ID NO: 36236 - DNA, 369 bp, Homo sapiens
  misc_feature 133: w=a or t
  misc_feature 134: k=g or t
  misc_feature 139: w=a or t
  misc_feature 142: d=a or g or t
  misc_feature 143: r=a or g
  misc_feature 148: r=a or g
  misc_feature 151: w=a or t
  misc_feature 159: d=a or g or t
  misc_feature 160: b=c or g or t
gagttcacatgtaaaattaaccataatagtgagttttatgtctttatattgtatcatgccaaaggcacttttaagaaagtttttctgataattttttcctgtaaaagttgtaagatacagaccaatccattcwkgttawttdragttragwtacagtgdbaaggtcctgagagtacttcattaatatttcttattttaatttgtctgacaatttatactcctactcacagtttgttagagtgcccctttttctcactttatctggattgtctcttttaatcattattaccaccctgtgacacatgattatttcccatttgtagataaggaagccaagaattagagaggctgagtgatatgcccaggcat

SEQ ID NO: 36237 - DNA, 185 bp, Homo sapiens
cacatgaatataactttattacagataagtaacatgatattgaaggggtgaggaagcaagaacctggtctaagtaactttggaaacttttgactggatactgtaaggttagagaccaacgaaattgtagcaaatcactgtgctctagatggtaaattcatccctcacatacacaaacacaaaggt

SEQ ID NO: 36238 - DNA, 151 bp, Homo sapiens
  misc_feature 144: w=a or t
  misc_feature 146: m=a or c
tttcttcagcatttccagcatccaagtaaacaatagtcccttatagtcctgctacttgatgggtaaatttggttgctgggtttttaagttgcactcacaataaatcgtgcaaagcattgtcatgccttatttactccatttttwamcccct

SEQ ID NO: 36239 - DNA, 109 bp, Homo sapiens
  misc_feature 83: w=a or t
  misc_feature 90: w=a or t
gcatctcggttggacaggttgagagaaacatgtcattaaggtattgtcaatatgagcccttcaggtgtgggcgttccctaggwttgtggwtttagactttcaaaggggc

SEQ ID NO: 36240 - DNA, 93 bp, Homo sapiens
agatttatgctttttacgtgaagctgctaaactaaaagtaaatggaagaaaccaagtctagtaggttttttctttttttttgtgggggcgggg

SEQ ID NO: 36241 - DNA, 162 bp, Homo sapiens
tataaaaacttgaaaaaaaattctgtcatgggttcttttccccttttattcattcactgtcatgacagttcccacacagtatgccccagttatggcttctgcattctcaaaaatccagcagtcttgggaaaacctttctatatgagtcatatacacaggcta

SEQ ID NO: 36242 - DNA, 143 bp, Homo sapiens
aaccaggctattagattgatagagggagaaaggcagttaaagggtttttttgttttttgttttttttgagtcagagtctcacactgttgcccggtctggagtgcaatggcgtgacctcggctcactgcaacctccacctccga

SEQ ID NO: 36243 - DNA, 78 bp, Homo sapiens
  misc_feature 13: k=g or t
  misc_feature 32: k=g or t
  misc_feature 49: s=g or c
  misc_feature 51: m=a or c
  misc_feature 54: r=a or g
  misc_feature 61: w=a or t
agcttctagtagkttccagaaggcggcgcgtkcggttgggaacgcggasamcgrcattcgwttcaacggggttccgga

SEQ ID NO: 36244 - DNA, 276 bp, Homo sapiens
taaattgtttgccagacattatatttgaaacattgtttgcagagataatctgaggtccaggatggtgtcatcaacattcagagaaggattatgtttgttcctgctagcgcctgtgggtataaccagtccaggatcacgtcaactcaattttagagaatgagatgatttgatgcctattgctgtaggttggaagtccttcagagttctacctcaatgtaataaggctcctgaggtactcaaccttggtggactttagactgtatttcttatccgcaa

SEQ ID NO: 36245 - DNA, 182 bp, Homo sapiens
tatttattatgattccacctcaaacatgaatttatttcaaaaatagtttgttctagaggattcaggatttttctaaattatcttgtgacctgggacacactgtcaagttttagaagagattaagagaactaaatacatacgccaagtcacgatttaaggcaaaacagataaaatgtgtaaaa

SEQ ID NO: 36246 - DNA, 287 bp, Homo sapiens
  misc_feature 286: w=a or t
caagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacawa

SEQ ID NO: 36247 - DNA, 109 bp, Homo sapiens
  misc_feature 91: m=a or c
gatctctgctcgccttgggcgcggggccgtgctggcgctgcggctcctcggcctgctccgccgtctggtggccgccccgggctgactttgmcttagcgatgcctttcct

SEQ ID NO: 36248 - DNA, 297 bp, Homo sapiens
caactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagat

SEQ ID NO: 36249 - DNA, 262 bp, Homo sapiens
  misc_feature 127: m=a or c
  misc_feature 164: b=c or g or t
aagctctttaagaaattgtgtgatagctaaatatacaattgtagtatttgtagtagtagtttgagttttctgaagtatgtaaccctgatgtattcattccttcatttgtttaaataaactttggcamcattactagaaaaattgtattattgagatggaaactbacaaattacttatttgcagtctgagtttggtttagatatcagtagaattaacttcagaactcctattccatgttctcaacttggtcactttttttttt

SEQ ID NO: 36250 - DNA, 225 bp, Homo sapiens
  misc_feature 143: k=g or t
tgtttgaggatttgaaaagttaatcttcaattatctggatttgaaaccagtctataactttttaagctaggaagaagtcaagaataagaagattgcaagcaaagggaaagcttacaaaatggctgaatccttaaagtgtagckcctggcttctccttggtaggaagcattagacatggtttccctctagggagctgggagcttttggtgtagttcaggagagatt

SEQ ID NO: 36251 - DNA, 150 bp, Homo sapiens
  misc_feature 118: r=a or g
  misc_feature 119: r=a or g
agtgtcggctgccggtgccgcggcctttgtctcgcagtcaggagggagcaagtgacatttgaggacgtggtagtggacttcagccaggaggagtgggggcagctgaagcctgcccagrrggaccctgtaccgtgatgtaatgctggacac

SEQ ID NO: 36252 - DNA, 168 bp, Homo sapiens
  misc_feature 123: k=g or t
  misc_feature 160: k=g or t
atcctgacacgcccatcgggagcctgaggagccagtgggctgcaggcgcaggcgcaggcgaggggctgggtggcggttgagacagcggcggtactgggaggcgtaggtgagggtcgcgaggckgcccgagcttctgagcgagcgcggtgcttttgggaakgcgggacg

SEQ ID NO: 36253 - DNA, 146 bp, Homo sapiens
cagatgctatgtgttgtatgacatgatgtatataatgtaagttactaaaactttttttggaagagaaaaagctagagtagcagatatgcacactaaaaggcaaaaatctggttttacaagttttataaataaaaaaggtggctagc

SEQ ID NO: 36254 - DNA, 120 bp, Homo sapiens
  misc_feature 70: m=a or c
cccaaagtgctggaattccaggcatgagccactgcgcccagtctacacactaattcttgttagcccaacmgctgttctgttctatctacccctcatttcacgctcaaggagtcataccta

SEQ ID NO: 36255 - DNA, 56 bp, Homo sapiens
  misc_feature 11: y=c or t
  misc_feature 23: y=c or t
ccttcccatcytagtaccattgyagttataaacatctgcattttttagaagcattt

SEQ ID NO: 36256 - DNA, 66 bp, Homo sapiens
cttcttcgtcagcctcccttccaccgccatattgggccactaaaaaaaggggggctcgtcttttcg

SEQ ID NO: 36257 - DNA, 146 bp, Homo sapiens
  misc_feature 35: n=a, g, c or t
atctttgccgccgctgccgtcgccttcctgggatnggagtctcgagctttcttcgttcgttcgccggcgggttcgcgcccttctcgcgcctcggggctgcgaggctggggaaggggttggaggggggctggttgatcgccgcgaga

SEQ ID NO: 36258 - DNA, 445 bp, Homo sapiens
  misc_feature 129: w=a or t
  misc_feature 130: w=a or t
  misc_feature 203: d=a or g or t
  misc_feature 373: w=a or t
  misc_feature 386: r=a or g
  misc_feature 407: s=g or c
  misc_feature 408: k=g or t
  misc_feature 409: k=g or t
  misc_feature 418: s=g or c
tatttggccaaatctagaagtaattgggaagtcggagtacttactgggaaggggagtactgggagtgggcatcgtaagactgttttcagaaccaggatccccacgttcgggaagagctgatttatctcwwgttattcacagtcatcttcttgactggctctcttttgggatgattttcagtaagaggtgtccttactgaacadgtgatctccctgcttctagaaacaacagtaaagaaaagggaggggtagaagttcatggaaagattcattgttcttgccagtaaaccctgttatctttctttttaagcaaagctttggaattggttatataaatgactttaaaaatacatatgggtgtctgtaactatgtwatgtaaatatggrctgtatgatatattattgtgskkgtgtattgsataacatataaaggcctccaactttaa

SEQ ID NO: 36259 - DNA, 322 bp, Homo sapiens
  misc_feature 151: w=a or t
  misc_feature 174: r=a or g
tgtatctgtaataattaaggatcacgccgggtgcagtggatccttagcctgtaatcccagcactttgagaggccgaggcgggtggatcacttgaggtcacgagtttgagaccagccctggccaacatgatgaaaccccgtctcttactaawaatacaaaaaattagctgggcgrggtggaggggcgcctgtaaccccagcttctcaggaggctgaagcaggaaaattgcttgaacctaggaggtggaggttgcagtgagccgagatcgtgccattgcactccagcctgggcaacaagagtgaaactccgtctcaaaaaaaaa

SEQ ID NO: 36260 - DNA, 78 bp, Homo sapiens
  misc_feature 7: m=a or c
  misc_feature 10: y=c or t
  misc_feature 15: b=c or g or t
  misc_feature 16: d=a or g or t
  misc_feature 57: w=a or t
taagtgmgayatgcbdtagaatttaaagggggcaatttaaaggggaggcatctttawctaaatttggcagctttaaat

SEQ ID NO: 36261 - DNA, 424 bp, Homo sapiens
  misc_feature 207: y=c or t
  misc_feature 332: n=a, g, c or t
  misc_feature 333: b=c or g or t
  misc_feature 376: r=a or g
  misc_feature 377: n=a, g, c or t
  misc_feature 378: n=a, g, c or t
tttttttctctgtaattctgggccgtgttccggaagcctcgtaagacaaaagcgaacgagaggcggaaaaaaggaagacgcttcctgaagttggggatgctggactagttttcatactagatcccctcgtggcagcattaaggaacttcacattcttctcacactattcatggaaagttcctggaactcccacagcagcaagaaaayttcgcttgtaggagtccttagcacatctgtaaagttttattggccaaaatgtgatacatctccatttctggatcagtcactgtggtcaagtgcaagacgctctacaggactcaacctggggatgnbgtctgtctactccatccatatggtcactttatactgaggttgrnntttgaactcagctctgcaccaagcggacctaatagacatctacaga

SEQ ID NO: 36262 - DNA, 432 bp, Homo sapiens
  misc_feature 381: r=a or g
ccctgggtctacctaatctaaaatgccagttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggaraggtgccatgctcacgtctgccctaattgataacaaagcgcaacataacga

SEQ ID NO: 36263 - DNA, 216 bp, Homo sapiens
agtttttgaaaatggtttcccacttacaaatatgtctatgttcttttcagtattttggtgtggaaatggaattgacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccc

SEQ ID NO: 36264 - DNA, 214 bp, Homo sapiens
taactagagtatattaatcatgttttcttattttctgtatgttatgatactttgacatcttgggaccctgcttgctggggagagtctgctcttcccagggttagctaaatcttagagatagaaaacacttgcccaggagtccattcttcaaatgcaaatcaaccaatccaggccccataccttcaaccacctcctctactgggccaagccacgt

SEQ ID NO: 36265 - DNA, 139 bp, Homo sapiens
  misc_feature 115: n=a, g, c or t
  misc_feature 116: v=a or c or g
  misc_feature 127: r=a or g
  misc_feature 128: w=a or t
  misc_feature 139: w=a or t
ttctccaatctagaggtcaaataaatagtgctttttttcttcctaatttcattttttaccattcactttttaaaaaactgattaaaaaaaaatacgttacgatgggaggttttcnvatcttccaatrwatcccctccaw

SEQ ID NO: 36266 - DNA, 96 bp, Homo sapiens
  misc_feature 60: d=a or g or t
  misc_feature 61: m=a or c
gaaaggtcatttgagtccttgagttcagaacctatctcttctgccaagtgatgacacagdmtatgatctagctcagaaaagttttacaatctgggt

SEQ ID NO: 36267 - DNA, 111 bp, Homo sapiens
  misc_feature 86: w=a or t
gaccaatttttccagatctctgtttgtggtgaggtgtaattatgtgtgtttttcctagcttagtgtgtgcgttctttctttttgtwtctgagaatgctgtgttgaggggat

SEQ ID NO: 36268 - DNA, 111 bp, Homo sapiens
ctatcgaattgaagctttgtatggccactcagacgcaaatgctgaaaacttaccatgcaaactgagttcaagtccatagtaaacgttgccagggactgtgaattgctggcc

SEQ ID NO: 36269 - DNA, 425 bp, Homo sapiens
  misc_feature 337: w=a or t
  misc_feature 338: n=a, g, c or t
  misc_feature 339: n=a, g, c or t
  misc_feature 412: r=a or g
attttcaagattggctccttaaaccacccacaaggcaccagctctgggagaagctgcagggagaagagaacaaagccctcgctgtgatcaggatgggtgtctcataccttttctctggggtcattccaggtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatwnngcgctgcacctggcgtgggacctgagccgcaattctgaacgagatgcgtgaccaagtatgagaagaatggcaragaagaaccgctc

SEQ ID NO: 36270 - DNA, 280 bp, Homo sapiens
  misc_feature 138: w=a or t
  misc_feature 172: y=c or t
  misc_feature 173: y=c or t
  misc_feature 257: m=a or c
tttgtgtgaaaaatcagaccttggcagtgaccttgagcagtaggatataaataactcccacaagcttagcattccaataatggaacactaggcataaatgggttaaaaactcccaggctcaagcgatccaccagtcawggcctcccaaagtgctgggattgcatgcgtgagyyaccatgcccagcctatttttccactttttcactcaacaggctttctctgaatgcctgctatatgccggacccagtgcctagcamacacttagtcacatgcagggagc

SEQ ID NO: 36271 - DNA, 118 bp, Homo sapiens
  misc_feature 15: k=g or t
tagtttaacaaattkaacaatgaggattaaatgagaaggcaaactgttaacttctcagctgtcagaatttgggtggaagggaataatggaagcctcttttgtgatctgcccgacctgc

SEQ ID NO: 36272 - DNA, 227 bp, Homo sapiens
  misc_feature 14: r=a or g
  misc_feature 15: k=g or t
  misc_feature 123: d=a or g or t
  misc_feature 137: r=a or g
  misc_feature 138: d=a or g or t
  misc_feature 160: w=a or t
  misc_feature 212: r=a or g
ccacagatttaaarkacttactgaatattctaaaggtgatgtcaggaagcataattttgggattaattttctagaatcttatataatgttcactctactaaacacagtacacggttggtaatdggagaatttcagcrdgagtaatgtcacttttttctawtaaaacaggtctcactgtctgtaagccaggcctgatcacctgcctggagcarcgaaaagagccctca

SEQ ID NO: 36273 - DNA, 192 bp, Homo sapiens
ttcaattaggaaaagaggaagtcaaattgtccctgtttgcagatgacatgattgtatatctagaaaaccccatcgtctcaggccaaaatctccttaagctgataagcaacttcagcaaagtctcaggatacaaaatcaatgtgcaaaaatcacaagcatttttatacaccaataacagacaaacagagaacc

SEQ ID NO: 36274 - DNA, 233 bp, Homo sapiens
  misc_feature 189: r=a or g
ccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggaggggcgcaggtacatgctagtttcrattaccacagtattctagagacgggttgcaatgacaagggaggc

SEQ ID NO: 36275 - DNA, 104 bp, Homo sapiens
cttatgagttgtttatttctggaattttccatttaatattttcagactgcagtcgactgcgggtaactgaaactgagaaaaatgaaaccacagagaagggggta

SEQ ID NO: 36276 - DNA, 75 bp, Homo sapiens
  misc_feature 24: h=a or c or t
  misc_feature 29: m=a or c
actggctgcgcggcctgcgcgcghctccmgggcggattccagccccgagcgggacagcgcggcggggagcgacga

SEQ ID NO: 36277 - DNA, 91 bp, Homo sapiens
  misc_feature 46: y=c or t
  misc_feature 81: m=a or c
ccctgtccagggaaggaacacgcccccggtgacagccggtacggcyccgggtttgggcaacctcgattacgggcggcctcmagccccgcca

SEQ ID NO: 36278 - DNA, 105 bp, Homo sapiens
gaagggaaaggaaatagctctacgagcggcatcctgcctgcgttagggcggtggaggaggaggcagagaggagtggagggcggagtagacggaggaggctgctgc

SEQ ID NO: 36279 - DNA, 73 bp, Homo sapiens
  misc_feature 28: r=a or g
  misc_feature 34: w=a or t
  misc_feature 35: r=a or g
  misc_feature 40: m=a or c
  misc_feature 41: w=a or t
  misc_feature 56: m=a or c
attagggctctggtggcggcggcggcgraccctwrgggtmwggacgcgacggcggmgggagcatgaacgcccc

SEQ ID NO: 36280 - DNA, 250 bp, Homo sapiens
  misc_feature 123: y=c or t
  misc_feature 208: n=a, g, c or t
  misc_feature 209: v=a or c or g
  misc_feature 223: w=a or t
  misc_feature 224: v=a or c or g
  misc_feature 228: b=c or g or t
  misc_feature 233: d=a or g or t
  misc_feature 237: k=g or t
  misc_feature 238: k=g or t
gaccagacggcaatcgaccagacggcgatcgggagctactaccagctgttcgcagcggctgtgggcaacgtggaatggctgcgattctgtctgaaccagagcctcagggaaatccccaccgaygacaagggcttcactgccatccacttcgccgcccaatggggcaagcttgcatgcctgcaggtcctggtagaggagtacaagtttnvcgtggacctgctgwvcaabaatadccakkccacccctacac

SEQ ID NO: 36281 - DNA, 83 bp, Homo sapiens
gagtatttcttgggaattccttcaaagagaattgatagcattgcagtattaattaagggaacgtgggaatttcttcgtgtatc

SEQ ID NO: 36282 - DNA, 161 bp, Homo sapiens
tcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagcg

SEQ ID NO: 36283 - DNA, 302 bp, Homo sapiens
  misc_feature 288: w=a or t
  misc_feature 293: w=a or t
tttgttttatttggttatttgttttgttttgtttctctgaggccaatgggtgggaggaagtataaagaagtgtaaacaggaaagccagctgggcctggagttccaagtgcccatatttcatcagcttcctctccataactgtggcagggacacttaacccttccctggctgtgagaagttattctctgagggctggtgagcagaatgggaagatctaagaggcagctcctttccttgcctggttcctttatccctgggaattgcaggccaaggattctgagcaatggwgaagwcagaaggaa

SEQ ID NO: 36284 - DNA, 343 bp, Homo sapiens
  misc_feature 322: h=a or c or t
  misc_feature 323: w=a or t
caagtatcttctctgaccaaaatggagtaaaactagaaattaacaagtggaactttggaaactgaacaaatatattgaaattaaacaacatgcttctgagtgacccctgggtcaaaggcaaaattaaggagaaaataaaaaaatttcttaaatgaaaattgatacataataccagaacctatggaatatagcaaaagtattgtgaatagagaagtttatagcaataaatgcctacatcagaaaagaaagatttcaaataaattatgtaaaaatggacttcaaggaaaaagaaaagcaagagcaagccaaacccaaaattaghwgaaaaaagactggagcagcc

SEQ ID NO: 36285 - DNA, 156 bp, Homo sapiens
atgggaacctcgccccttctagagtcctggccgcttgactcagctaagcgcgaaggtgttgtttcttcctgaggtgcgctggggctgggacccggtctgcagaaggtccaggggatggcgtcgggggattgagaaagaggagaccaagccggcgcc

SEQ ID NO: 36286 - DNA, 104 bp, Homo sapiens
acacaaaccacacagactttaagccttgtggagctgcccaggtggtgtgtaggaaattttggtagagaaagaaatagtttgaaagttggtttctgacaagagga

SEQ ID NO: 36287 - DNA, 260 bp, Homo sapiens
  misc_feature 15: r=a or g
  misc_feature 146: r=a or g
  misc_feature 151: d=a or g or t
  misc_feature 179: d=a or g or t
tatctctattttaaraaatcattagaaaagagaagaacattttataataacaaggtgcaatttatcaggaagatataacaatcaagcttatacacatctaacaaaagagctctatgtggattgaaggaacaaaaggcaactcaatratggdtgaagccttcaatacctactttcattadtgactgaagatcaataaggaaatagtggcagcactatcagccaactagacccaacagacatctatagaacactccacccac

SEQ ID NO: 36288 - DNA, 122 bp, Homo sapiens
  misc_feature 10: w=a or t
  misc_feature 80: r=a or g
  misc_feature 85: v=a or c or g
  misc_feature 117: m=a or c
gagtggttgwgtctgttcctccggtaaggggtgattcgccgaggggcgcggaccagacagacctcgggtcaggcccgggracccvgagaggagagcccagcccctggtggaggcggmttggc

SEQ ID NO: 36289 - DNA, 421 bp, Homo sapiens
  misc_feature 142: k=g or t
  misc_feature 191: k=g or t
  misc_feature 211: k=g or t
  misc_feature 277: n=a, g, c or t
  misc_feature 293: r=a or g
  misc_feature 320: k=g or t
  misc_feature 339: w=a or t
  misc_feature 340: n=a, g, c or t
  misc_feature 341: n=a, g, c or t
caattttctttctttcctggttattgcttttttgtgacctgaggaacttttgccttccccaaagtcacaaggatgacgttggtttgctctaaaaacgtcatcgctttagcttttatacttaggcctgtaatgcatcttgaakgaacttctgtgtatatcgtagtttgtggttcacttggtaacatatggakatccagtatcccagctacakttttccaaaaaacttgaccaaatagatttcttggggatctttgtaatcaaaaatcagttgtgtaangtagaatcataaatgraaatctatttcttggtgctctcttgtktcattgatgtctttgtagwnntttacacaaggtactgcttttccttgaaatctgttgctttatgatgttatatcttgaaaataggttgtaggagcctacct

SEQ ID NO: 36290 - DNA, 98 bp, Homo sapiens
  misc_feature 8: m=a or c
  misc_feature 17: w=a or t
  misc_feature 20: k=g or t
  misc_feature 34: m=a or c
  misc_feature 48: w=a or t
  misc_feature 57: m=a or c
  misc_feature 89: w=a or t
ttggggamcctgcttawatkcctatatataatamaatataattcttgwatgtttagmttatgtgaggtcttgattattcagaaagcccwctggactga

SEQ ID NO: 36291 - DNA, 93 bp, Homo sapiens
ttaagattatgcaatattatatataattctcaaatcccttaagggagatcagaaactactgaaatataagagatttttgtcacctctgaaatt

SEQ ID NO: 36292 - DNA, 102 bp, Homo sapiens
  misc_feature 36: w=a or t
  misc_feature 46: k=g or t
  misc_feature 85: k=g or t
  misc_feature 86: d=a or g or t
aatttatttaaccagtcctttaggttgtttccaatwcattgcagtkagaaatgatgttgcaataagcatctttatgttcatatckdtgtgtatagatgtgta

SEQ ID NO: 36293 - DNA, 134 bp, Homo sapiens
  misc_feature 5: w=a or t
  misc_feature 6: w=a or t
  misc_feature 62: w=a or t
  misc_feature 87: r=a or g
gatcwwggctcactcaaattcccccactctgccacttctaccttttacaacctagggtcatwatttaatttctgtgatcatgaatgrtaccgagggggtgatgatatctgcgtggtaggttatttatgaagggt

SEQ ID NO: 36294 - DNA, 292 bp, Homo sapiens
  misc_feature 106: m=a or c
  misc_feature 125: v=a or c or g
  misc_feature 154: s=g or c
  misc_feature 185: b=c or g or t
  misc_feature 221: d=a or g or t
  misc_feature 222: k=g or t
  misc_feature 245: k=g or t
  misc_feature 247: v=a or c or g
  misc_feature 256: k=g or t
  misc_feature 263: r=a or g
aaaaagttaaaatttaaaagttcatagctgggcaccatggctcacatctctaatcccagcagtttgtgaggccgaggcgggaggatcacttgagcccaggaattcmagaccagctatgttaccavgaggcagcatagcaagactccatctctasaaaaaatttaaaaattagccaggcgttatgbaatgtgcctgtggtcccagctacctgggaggctgadktgggaggactgcttaaacctggkavgtggaagckgtagtgrgccaggatctcaccactgtgttccagcct

SEQ ID NO: 36295 - DNA, 109 bp, Homo sapiens
  misc_feature 30: s=g or c
  misc_feature 31: h=a or c or t
  misc_feature 45: s=g or c
  misc_feature 46: s=g or c
  misc_feature 62: w=a or t
  misc_feature 70: m=a or c
  misc_feature 94: r=a or g
taaaggtgattttattttcttatggacagshaaaaagaaaatgassaggagttggttttacwcttagagmtaagacttcagcaggggctcagaraccccaaactctagt

SEQ ID NO: 36296 - DNA, 199 bp, Homo sapiens
  misc_feature 116: k=g or t
  misc_feature 136: r=a or g
  misc_feature 137: r=a or g
  misc_feature 167: s=g or c
  misc_feature 197: m=a or c
  misc_feature 198: w=a or t
cagtttttcaccgttaccaagaatgccaccctggctgcctctgagtgtgttgacttcactacatgtatgtggagggttcctgcaggaggggtttcacagttctgacctcaggtgakctgcccacctcggcctcccrrattgctgggattacaggcatgagtcactgsacccagcgcatgagtaactgcatccagccmwa

SEQ ID NO: 36297 - DNA, 208 bp, Homo sapiens
  misc_feature 81: y=c or t
  misc_feature 115: w=a or t
tagtatgggaagaaaactgagacagtcttatattatttattaaaattataccaatctttgagaaaaataggattacctggyagaactttatgtcaggcactttccaacactattwctttttttgcaattgatctgaaatgtttaagagctgtataaaatttttactccatttgtgggcctgagtcatcaggcatagtcattgccacca

SEQ ID NO: 36298 - DNA, 359 bp, Homo sapiens
  misc_feature 22: w=a or t
  misc_feature 49: m=a or c
  misc_feature 102: w=a or t
  misc_feature 157: m=a or c
  misc_feature 171: m=a or c
  misc_feature 216: b=c or g or t
  misc_feature 263: m=a or c
  misc_feature 264: w=a or t
  misc_feature 265: h=a or c or t
  misc_feature 301: r=a or g
  misc_feature 321: m=a or c
  misc_feature 326: w=a or t
attctgcgtcttcctttaggcwgcggcgagacaatccccagagccccgmggcccggcctcggggcagccatggactcgcaggaattgaagactttgattaawtactattgtcaagagagatatttccatcatgtattactggttgccagtgaaggamttaagaggtatggmagtgatccagtcttcaggttttatcatgcctatggcacattaacbgaaggtaaaactcaagaagctcttcgagaatttgaggctattaaaamwhaacaagatgtatcactttgttctctacttgcactgrtatatgcccaataaaatgamgtccwaatccagatagagaagctattctggaatcagat

SEQ ID NO: 36299 - DNA, 284 bp, Homo sapiens
  misc_feature 94: w=a or t
  misc_feature 95: m=a or c
  misc_feature 111: w=a or t
  misc_feature 115: b=c or g or t
  misc_feature 125: m=a or c
  misc_feature 127: w=a or t
  misc_feature 134: w=a or t
  misc_feature 170: k=g or t
  misc_feature 235: m=a or c
cactatcacaagaatagcatgggaaagactggcccccatgattcaattacctccccttgggtctctcccacaacacgtgaaattctggtagatwmaatttcaagttgagawtttbgggtggggamawagccaawccatatcattctacccctggcccctccaaatctcakgtcctcactattcaaaaccaatcatgccttcctaacagtcccccaaagtcttaactcttttcagmattaacccaaaaatccacagtccaaagtctcatctgagacaaggcaagt

SEQ ID NO: 36300 - DNA, 220 bp, Homo sapiens
attgacacttctctcgaagaaggagaccgcgtcccctgcgctctcagagccgcagcctggccaacaaggatgccagctttctccctgaaaaagtatccactatgccgacagtcctttcttggcttttttgtgtggtcttaccacttaagcatgaatccctaaacgctatacttacttttgtctgtgtttgaacttcatattgtgaaaaaatagagtggcg

SEQ ID NO: 36301 - DNA, 149 bp, Homo sapiens
  misc_feature 28: w=a or t
  misc_feature 141: b=c or g or t
  misc_feature 142: r=a or g
  misc_feature 143: d=a or g or t
aagttcgccgccccgacccgcggcaagwactggatagccctcatccccaagggcaactgcacgtacagggataagatccggaacgcgttcctgcagaacgcctcagccgtggtcatcttcaacgtgggctccaacaccaabrdgagcca

SEQ ID NO: 36302 - DNA, 120 bp, Homo sapiens
  misc_feature 16: b=c or g or t
  misc_feature 50: m=a or c
ggccgggcgcggtggbtcacgcctgtaatttttaaatttttagtagagamagggtttcaccatgttgttcaggctggtctcgaactcctgacctcatgatccgcctgcctcagcctccca

SEQ ID NO: 36303 - DNA, 116 bp, Homo sapiens
  misc_feature 16: s=g or c
  misc_feature 17: y=c or t
aaattaaaaataaatsyaaaagattacaaggtaatacaatgaataagttcatactatgaaatgacacaactttgatgacatggaaaaattcctagacacaatctgtactgactcca

SEQ ID NO: 36304 - DNA, 149 bp, Homo sapiens
ttctcctgcctcactcagcctcctgattagctgggatcacaggcgtgtgtcaccacacctggctaatttttatatttttggtagagatggggttcaccatgttggctaggttagtctcgaactcctgatctcagatgatccgcccgcaa

SEQ ID NO: 36305 - DNA, 150 bp, Homo sapiens
  misc_feature 16: w=a or t
taatagttataaaaawataaaattgccttcttaaacattttcaattgtacggtctagtgatgttaagtatatttacattatattgcaatgggtgtctagatttattttatcttgtaaaatacaatacccaataaaaaataaactgcccat

SEQ ID NO: 36306 - DNA, 261 bp, Homo sapiens
  misc_feature 16: w=a or t
  misc_feature 17: k=g or t
  misc_feature 131: b=c or g or t
  misc_feature 202: w=a or t
tctattttattttcawkgtttttggttagtcctttgtttgcctcagctgttgttaatctcctcaggcagccacaaagttaaaacacttgcctgtaattgtctccaaaaataacatcacctgacagaaatcbtctgaagtgagtgagctccaaggcagcctcttaatgagtttttcaagagaaccaccagacaaataagaaawgataatattggctgggtgcagtggctcatgcctgtggtcccagcactttgggaggccgc

SEQ ID NO: 36307 - DNA, 423 bp, Homo sapiens
  misc_feature 176: k=g or t
  misc_feature 255: s=g or c
  misc_feature 256: r=a or g
  misc_feature 318: r=a or g
  misc_feature 319: n=a, g, c or t
  misc_feature 320: d=a or g or t
  misc_feature 406: w=a or t
ctaatatttcactcctacacattaactaaaactgtttaattaatggcagattcctcagtgaccaaattgactccctcattttgtatcccttctcctagaacgatctgtgacattaaaattccgccattcatgctctgtatttttcattgcctttattgacgtctgtgaccataggkcactttgctatgcctactttttaatttttcaccacctactctctattattttctctcattgttcaatccagaaatattsrtttaatgagaataaaagcagattcaaaatcatgttgaagctactttaaagctttaaagaccrndaaagctttaaaggctacttatatgtcaacagagaagtaaattggaacaatcttcagcagaaaatggcaggaacagaattgtgttgwcacttatgtgttaggta

SEQ ID NO: 36308 - DNA, 75 bp, Homo sapiens
aaaaccctcagggacctggtatagacgcagaatctgtttcacacaacaattgctatttgaaggaaaaaaaaaaaa

SEQ ID NO: 36309 - DNA, 104 bp, Homo sapiens
  misc_feature 15: n=a, g, c or t
  misc_feature 55: w=a or t
  misc_feature 56: y=c or t
  misc_feature 81: r=a or g
  misc_feature 86: w=a or t
tatactgtgaggctntgcaacagaggaatacaaaaacttgtcacttgtttagaawyaggaatttatcttgatagtgattgratttwatcctaatctaactctta

SEQ ID NO: 36310 - DNA, 148 bp, Homo sapiens
  misc_feature 14: k=g or t
  misc_feature 15: k=g or t
  misc_feature 41: k=g or t
  misc_feature 85: w=a or t
  misc_feature 96: w=a or t
  misc_feature 104: r=a or g
  misc_feature 105: r=a or g
  misc_feature 118: k=g or t
  misc_feature 119: d=a or g or t
  misc_feature 127: b=c or g or t
ggccttcttgttakkctgccagaagactggcagctggtgtktatcttttcccttcaagacttgggagttaacagctttatagatwagtgcagtctwgatcatarrcccaacagcattkdcaagaacbcatagcattagcctgtccctt

SEQ ID NO: 36311 - DNA, 123 bp, Homo sapiens
ttaattatggccatcaataaatcattttatccttgaacaagacttgagaatggcctgaaggcagaggcacgattccttaggaattaggccaacagagaatgggctatctctcttcccacccct

SEQ ID NO: 36312 - DNA, 81 bp, Homo sapiens
  misc_feature 78: k=g or t
tatttggatgaccttattgttaaataaggtctagcgtggaaaagatgttttgcaagtgcctggctcagagtaaacggkcac

SEQ ID NO: 36313 - DNA, 168 bp, Homo sapiens
  misc_feature 84: d=a or g or t
  misc_feature 85: s=g or c
  misc_feature 118: d=a or g or t
  misc_feature 119: r=a or g
  misc_feature 121: m=a or c
  misc_feature 125: w=a or t
  misc_feature 136: r=a or g
  misc_feature 137: r=a or g
  misc_feature 149: y=c or t
  misc_feature 164: w=a or t
gtgtgtgtggggggtgggagcgggggggaggagggcattgaggggaggaagatttgagatttcctcctcttaatattaaacccdscatcccagccccctgcacccctggcagggagadrcmagawcagcccttacrrgacacggaagaygcacgacccaacgawccct

SEQ ID NO: 36314 - DNA, 256 bp, Homo sapiens
  misc_feature 114: m=a or c
ttaattgcagttatgtgttacttaatgacgagaatatcttctgagaaatgcatcatgattttgtcatgtaaacatcatagggtgtatttacacaacttagatggtgtggcctamtgcacatctagggtatatgatatggcctctgggtcctgggatacaaacctgtgcagcttgttattgtactgaatactgtaggcaattttagcgcggtggcgtttgtgtatctaaacatatctaaacatagaaaaggtacagt

SEQ ID NO: 36315 - DNA, 227 bp, Homo sapiens
  misc_feature 16: r=a or g
  misc_feature 169: d=a or g or t
catccttgtagtacaragcttttcattggttactgaaaaccattctgctatagaatagctaagtccctgctggccagctgctgttggtgtgaaagtggagaagctagctatagtgggtacttttcaggaagttggagataaagtttatgatgtcatttgaaactttttdgatgatgtgaggaaagaatgtcaaaacggttaacactctggaagatataagaaggcac

SEQ ID NO: 36316 - DNA, 200 bp, Homo sapiens
  misc_feature 127: k=g or t
  misc_feature 132: r=a or g
agaaaaggctttcgtactttttcacattcagtatgatgttagctgtgggtttgtcgtatgtggcatttattatgttaagacattgaacttcacttcctccttggaagctagatttggccatgtgatkagctrcagttaatgtttgtaagtggaagccttaaaagttgatgtgcaatttgctacactcccttcccacttca

SEQ ID NO: 36317 - DNA, 326 bp, Homo sapiens
  misc_feature 17: d=a or g or t
  misc_feature 18: k=g or t
  misc_feature 102: m=a or c
  misc_feature 262: r=a or g
  misc_feature 281: d=a or g or t
  misc_feature 302: w=a or t
  misc_feature 303: w=a or t
  misc_feature 309: w=a or t
atagagaaaattccaadkgtgaaaatgattaagatttaggtgcaaactggggtaagaaacacagacactaagagattggaaaagaggtcagtgttgcagaamtggaatatcaaggtggtttatatgaagcagatgttcaggtcttgagctgtggctggtggtggaggctcattttgtctgtgagtgaatgccattgccaaagcagtgacttgaatagaataaacggggattgaagaaacccttggggaacctctgtattctrgctctttggaggaaaaaadagcagccatgaccatagcagwwgggaawgtcaaagaggatgggat

SEQ ID NO: 36318 - DNA, 245 bp, Homo sapiens
ggacttgtgcccagagagagagagaaaaactgctgaccctgtaagagagaactggccatcttgcagacagacagaggtgagccaggaattaacaagcatgccaaggagtacagctgtaagtgtgggagcggcaggagccacagagccgtttgctgagaagggctgcggtcggaggaggcagccgagacagaggcagacagtgtgagagctgcagcagctgctgctgaataaaatcatattttacc

SEQ ID NO: 36319 - DNA, 245 bp, Homo sapiens
  misc_feature 79: m=a or c
  misc_feature 80: s=g or c
  misc_feature 84: m=a or c
  misc_feature 101: w=a or t
  misc_feature 104: w=a or t
  misc_feature 121: w=a or t
  misc_feature 126: m=a or c
gtcatttcctttcttcatgtaccagatgctgaaatactatgagataaagattttaggtttcaattgtaaagagagagamstggmtaaatcagtgctgcttwctwtaggacgaaagaagtawggagmagtgggatcactttcacaatcaacaggaggacactgatagctgctccgaatctgtgaaatttgatgctcgctcaatgacagctttgcttcctccgaatcctaaaaacagcccttccctt

SEQ ID NO: 36320 - DNA, 87 bp, Homo sapiens
cctttgggtatatacccagtaatgggatggctgggtcaaatggtatttctagttctagatccctgaggaatcgccacactgacttcc

SEQ ID NO: 36321 - DNA, 283 bp, Homo sapiens
  misc_feature 90: s=g or c
  misc_feature 107: w=a or t
  misc_feature 111: m=a or c
  misc_feature 273: m=a or c
  misc_feature 276: m=a or c
tttcaccgtgttggccaggatggtctcgatctcctgaccttgtgacccgcctgccttggcctcccaaagggctgagattacaggcgtgascaccgccccctgtcatwgtgmccattttatagatggggctcctgaggccaggggtgaaggcaggtgctagttcgggggatccaagccctgccagactctgctgcatgtgggctctgacctagtgaagttccaggatggtgccctggggccgggctgtcaggccctccacgtgggttatgtcamctmacccttt

SEQ ID NO: 36322 - DNA, 142 bp, Homo sapiens
  misc_feature 127: d=a or g or t
cccgtattatgtactggtactgtgggaggaccaaggctcagagcgtctgacttacgggtttaaggtctcacggccattaagcagtcatggcaggattaaaggagatgcagcagatctgaattggctdcatatcacggccccc

SEQ ID NO: 36323 - DNA, 179 bp, Homo sapiens
  misc_feature 113: s=g or c
acaatttttatttatttttgaaacagggtctcattctgtcacccaggctggagtgtagtggcacagtcacggctccctgcggcctcgacctcctcaagcgatcctcccacttscagcctcccgggtggctgggactacaggcacgtgccatcacacctggtctcactatgttgcccatc

SEQ ID NO: 36324 - DNA, 218 bp, Homo sapiens
  misc_feature 150: w=a or t
  misc_feature 153: w=a or t
caaatgaatacaccagtgttaagagtataagagtgtaatagtacctttaaaaatgcctcaaagataaatcttttgatttatctttatttttagatctctacccccactttagccacttctgaaatttactactagaaaaaccttttcttwcgwgaagaactgtctcacaaaaatagcagttaaataggaagctatcctaacccactgtttgccttttc

SEQ ID NO: 36325 - DNA, 331 bp, Homo sapiens
  misc_feature 110: r=a or g
  misc_feature 113: m=a or c
  misc_feature 148: n=a, g, c or t
  misc_feature 149: r=a or g
cttttggctgggcatggtggctcatgcctgtaatcccagcactttgggaggccaaggtaggtggatcacctgaggtcaggagttcaagaccagtctgggcagcatggtgraamgcctgtcctctgctaaaaaatacaaaaattagctnrgcggggtggcgtgtgcctgtggtcccagctgctcgggaggctggggcaggagaatcgcttgagcctgggaggcggaggttgcagtgagctgagattgtgccattacactccagcctgggtgatagagcaagactccatctcaaaaacaaacaaacagaaaacactcatttttccaccagtgc

SEQ ID NO: 36326 - DNA, 98 bp, Homo sapiens
ttttctcctttctctcctttttctccctcctccttgtctcttttactccattcctgcagaagagagagggctaaacttaaagaaaaaaaaaaggagga

SEQ ID NO: 36327 - DNA, 344 bp, Homo sapiens
  misc_feature 323: w=a or t
  misc_feature 324: w=a or t
tattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacawwacatcaaatcctgcccccga

SEQ ID NO: 36328 - DNA, 325 bp, Homo sapiens
  misc_feature 34: k=g or t
  misc_feature 35: s=g or c
  misc_feature 118: d=a or g or t
ttatacttttagattttacatttaagtctttaakscatgtcgagttgatttgtgtatatggtgaaaggtagggatccagtctcaatattctacttgtggctagccagttatcccagcdcgatttattgaatagggagtcctttccccagtgcttgttgttttcaactttttcaaagattagttggtggtaggtgtgcacctttgtttctgggttttctgacttgttctattggtctatgcatcagtttttgtaccagtaccatgctgttttggttattgtagccttgtagtatagtttgaaatcaggtagtgtgatgcctctggc

SEQ ID NO: 36329 - DNA, 317 bp, Homo sapiens
ttaattttggtaagttccttcttattctcttcttctgtctttacttgtttatggaatcggtgttgtgggcttaaaactagtttattttagggggtcattaaaaatgtctgaaaaatacattttcaaatcccaggacctatcttttcatggcaaagaggaaattttgtgtacagttatgctaatgtttataaaaaaatttctgtacttaaaacgtttgtagatgtacaactatccttaagtgaagagcatagtaatagtgcacaaagttctcaaaacacaaacatctggctaacatgttacgaatattccaggggcac

SEQ ID NO: 36330 - DNA, 85 bp, Homo sapiens
  misc_feature 56: m=a or c
agaggaaagagaaactgggagagggaggaagggagaaagtgagaagggaaatcggmaagagaaaagggaggaaacggcagagcca

SEQ ID NO: 36331 - DNA, 229 bp, Homo sapiens
gtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccacct

SEQ ID NO: 36332 - DNA, 377 bp, Homo sapiens
  misc_feature 363: m=a or c
  misc_feature 373: r=a or g
  misc_feature 374: m=a or c
attcagtgaagcagacatggcctattccctacatttgccccttgaaaatgttcaattttaatttaaaagattaatacagccaggatattctttcaacaggcaaataaaaaaccgcagtttaaactctaagtttcaatcagaaactaacagctcttggatttcccagggctcacactcctctgaaacaactcacgaagagcctgaggaagcagttctcactggaaaatgcaagaaagtatgttccggtgaagaccctcagctctgttcattttcatgatgcaaatgcccacaaaggtggttttgacctgactgaccctgtgcaaggaggcacagtctcctcaccagcataagcacgtggcatcmgatgcggaarmagc

SEQ ID NO: 36333 - DNA, 262 bp, Homo sapiens
  misc_feature 112: m=a or c
  misc_feature 113: h=a or c or t
gaggtaaggagagaaaaataattgaggtaactgtgggtgttttacatctcggaaaccatggcttttaataaggccacatgaagagagaagctggcatcatcccacgcaaaamhccagtgcctggcagagttgtggaaggtgctatcacattggcttggcatttgtgtagctttgattgaaaatcaatggttttcttatgataattttcacatcatattttttttcttctttagaaaataataaaatttctgaatgggtcagc

SEQ ID NO: 36334 - DNA, 89 bp, Homo sapiens
  misc_feature 53: v=a or c or g
  misc_feature 54: v=a or c or g
gttcgcctagcgcgtgctcaggagttggtgtcctgcctgcgctcaggatgcavvgggaatctggccctggtgggcgttctaatcagcct

SEQ ID NO: 36335 - DNA, 244 bp, Homo sapiens
gacctaaatggaatctcttttctttttctcctcctcctaccctttttactttaaagggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagc

SEQ ID NO: 36336 - DNA, 255 bp, Homo sapiens
ctacttattttattgattattgagagagaagggttgaattatctaggtgcaatatagattttttctgtttcttatttcaggtctactggtttttacttcatatatttttgaagctctgttgttagtatatacactcttatgactgttaagtcttcttggtgaattgaaccttttattattaaataataccacttttcctccctggtaatagtccttcttaaatctactttgtctgatattaatactgtcacaacc

SEQ ID NO: 36337 - DNA, 401 bp, Homo sapiens
  misc_feature 294: n=a, g, c or t
  misc_feature 295: r=a or g
  misc_feature 296: r=a or g
  misc_feature 393: r=a or g
ctagtacttatcgagttctatatacccagcatgtgtatcatctcatttgattcttacaacagtcctgtaagttgtgggcactttaccccattttacagatgaggatattgagacatagagaaacatagtttcacttagctgctaagttacagagccagggtgtgaactcaggtctgactccaaagcccatgctcttaactgttaaactaagctctgctaaataagtcagttttgtgtcctttgtcagaactgttttagcaaagtagagtagtttttgccgccatccttatgagnrrgcttacgtggtggattttgcttatcagctggcactataaattgtaccagtcagctgttagctaatgtgtttatgtttagcaatggttacctctgatragtacagt

SEQ ID NO: 36338 - DNA, 234 bp, Homo sapiens
  misc_feature 119: k=g or t
  misc_feature 181: m=a or c
  misc_feature 190: k=g or t
aaagtaagtggttcgttctcccagtgagcagcaccagcaaaatcagtatgggccagatttgaatttccttaccataagtagtcttagctttataattcatccatttcttttttcctggkattttgttttaagtgaaattcttcagcaaaaatccaacttgcttaaggctgaattatgacamaagacagtkgcttacatctggggcttttattcttgtttgtccataaacccaga

SEQ ID NO: 36339 - DNA, 269 bp, Homo sapiens
  misc_feature 209: r=a or g
  misc_feature 224: d=a or g or t
aaatgtttccaggcgtaatgaaaaacctgatagttcttttgatctttgtaagtttaaaagtttttaagaaaaagaatttagtatcgtaatacaataatagctagaaggtgtttgataaattggtaaagataatatttcaaaaggtccactgtttcccaagagtatctctattaagacctgagcttttcttaaactgtattacttttcgrttgcacagttttttdacacaggctttgatttgttttccaaagaagtaatgaatggtggca

SEQ ID NO: 36340 - DNA, 430 bp, Homo sapiens
  misc_feature 178: d=a or g or t
  misc_feature 179: w=a or t
  misc_feature 423: s=g or c
caacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggdwgcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggasatgtagt

SEQ ID NO: 36341 - DNA, 169 bp, Homo sapiens
  misc_feature 16: y=c or t
ggccgggcgcggaggytcacgcctgtaatcccagctctcagggaggctaagaggcgggaggattgcttgagcccaggagttcgagacctgcctgggcaatatagcgagaccccgttctccagaaaaaggaaaaaaaaaaaaaaaaaaaaaaaaaaaaaaaaaaaaaaaa

SEQ ID NO: 36342 - DNA, 260 bp, Homo sapiens
  misc_feature 14: m=a or c
  misc_feature 45: r=a or g
  misc_feature 90: w=a or t
  misc_feature 117: r=a or g
  misc_feature 152: k=g or t
  misc_feature 189: w=a or t
  misc_feature 190: w=a or t
  misc_feature 200: k=g or t
  misc_feature 206: m=a or c
  misc_feature 238: k=g or t
caactaaaatggamataaataattcctaagtaatttgcctgttargattaaagtctccaagagaatggctgtgcctagtacctaagtgawtaatttccttgattggttcacattatrttgaggatattagtaatcagtagtgattccttttktggttcaaagatgatagtgtcacagtgaaaaatgttwwtaaaattttkgtatamttaatttttctgttaacgaaagtattttcagktggatttttgtttgccctctca

SEQ ID NO: 36343 - DNA, 156 bp, Homo sapiens
  misc_feature 142: w=a or t
gataaatgtttgagatggtggatgtactaattgccctgatctgatgactatacattatatatattgaaacatcagtatgtaccccatgaatatgtacaattatatgtcaacttaaacacatttaaaagtaaaaaaaaaaaawtccaaaacacgcaa

SEQ ID NO: 36344 - DNA, 79 bp, Homo sapiens
  misc_feature 8: k=g or t
  misc_feature 14: k=g or t
ttagaatktcattkgttttaaaatttattttacttcatgttctgggatacctgtgcagaatgtgcaggtttgctacata

SEQ ID NO: 36345 - DNA, 299 bp, Homo sapiens
  misc_feature 222: d=a or g or t
taccaaaatattgatgaaaattaaaaatttttagttgacttgtgaaataccttttagaaatgtatttgattagacagtagatagaaattgattttaaaaattcattttatactattgcatttcaattccacatatgaagagtagtgttcttctgatcctccatttttttggttttgtttttgtagaatacagagagcagatttctctaatgttttccagggdacattaagtccaagtggatattaataggcttggtggggaaggtgttagtgtgcatttgctgttcttcagccaagtaa

SEQ ID NO: 36346 - DNA, 198 bp, Homo sapiens
  misc_feature 15: r=a or g
cactttatttatttrtatattttttgagatagagtctcgctctgtcgcccaggctggagtgcagtggcacgatctcggctcactgcaacctctgcctcctgggttcaagtgattctcctgccttagcctcctgagtagctgggattacaggcatgcatcaccacacctggccaatttttgtatttttagtagagacgg

SEQ ID NO: 36347 - DNA, 457 bp, Homo sapiens
  misc_feature 159: r=a or g
  misc_feature 357: w=a or t
  misc_feature 359: n=a, g, c or t
  misc_feature 360: n=a, g, c or t
  misc_feature 363: d=a or g or t
  misc_feature 451: r=a or g
aaatacatatatgacagacccaaagctagtattatactgaataaggaataactgaaagactttcccctaagatctggaataagataaggatgcccattttcactgctgtttctcaacatagcaccagaagtcctagctagggcaatcagagaagagaaraaaataaggaacatccaaattagaaaggaggacatcaaattatcattgattgcagatgatatgatctaatatttggaaaaacctaaagattccactaaaaacctattagaactgataaacaaactcataaagttgaggacacaaaaccgacatacaaaaatcagtagcattctatatgccagcagcagacaatctgawanngadgtcaagaaagtaatcctggccaggtatggtggctcatgcctgtaatctcagcactttggtaggccgaggcaggaggatcacttgatgraggagt

SEQ ID NO: 36348 - DNA, 308 bp, Homo sapiens
  misc_feature 244: y=c or t
  misc_feature 271: v=a or c or g
  misc_feature 280: n=a, g, c or t
  misc_feature 281: n=a, g, c or t
  misc_feature 307: n=a, g, c or t
  misc_feature 308: k=g or t
agcccagccctaccgcgcgcggcccggagctctgttccctggaactttgggcactgcctctgggacccctgccggccagcaggcaggatggtgagctccctgcatcctgttctgtgcacaggggtgggcagagccagtcatgggagacccctctgtgcgtgtgtctgtgtgtgcgcgcgcgctgggagctgcctcacacctgataaaaaagccagtggaggagtgagcgctgctattttaagtygctgaatggaacctctgggaatgatavagggaagcnncaaagattaggcagagaagggcccgnk

SEQ ID NO: 36349 - DNA, 114 bp, Homo sapiens
gcatctcggttggacaggttgagagaaacatgtcattaaggtattgtcaatatgagcccttcaggtgtgggcgttccctaggtttgtggttttagactttcaaaggggcggttt

SEQ ID NO: 36350 - DNA, 203 bp, Homo sapiens
tccaatttccttatttctctcacatgatgcctctgactttcatagtgtggcttggtcagatgggccttatcaatagagatggcctgatgtctcagctgtgtcatctcagctgctagttctggcttctgctgggagtccacagtggcctctgcatgcatggtgtgggaaaggcaaataaaaaagcagattaaaaaccagatgac

SEQ ID NO: 36351 - DNA, 414 bp, Homo sapiens
  misc_feature 373: d=a or g or t
  misc_feature 374: n=a, g, c or t
tcagttcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgattgacatttgggttggttccaagtcttgctattgtgaatagtgctgcaataaacatacgtgtgcatgtgtctttatagcagcatgatttataatcctttgggtatatacccagtaatgggatggctgggtcaaatggtatttctagttctagatccctgaggaatggccacactgacttccacaatdnttgaactagtttacagtcccaccaacagtgtaaaagtgtt

SEQ ID NO: 36352 - DNA, 279 bp, Homo sapiens
  misc_feature 104: b=c or g or t
gtaggatttaggaacgcaccgtgcacatgcttggtggtcttgttaagtggaaactgctgctttagagtttgtttggaaggtccgggtgactcatcccaacattbacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgact

SEQ ID NO: 36353 - DNA, 99 bp, Homo sapiens
  misc_feature 15: k=g or t
  misc_feature 16: w=a or t
aaaaaggcttggagkwggtctagtaaggcgaacggactgcttccggccagaggtcccgggcggaggaggaagctgtggctgccggcggtgggacgcccc

SEQ ID NO: 36354 - DNA, 413 bp, Homo sapiens
  misc_feature 102: w=a or t
  misc_feature 108: s=g or c
  misc_feature 113: r=a or g
  misc_feature 137: r=a or g
  misc_feature 144: v=a or c or g
  misc_feature 184: s=g or c
  misc_feature 185: r=a or g
  misc_feature 188: r=a or g
  misc_feature 294: v=a or c or g
  misc_feature 297: m=a or c
  misc_feature 300: m=a or c
  misc_feature 302: v=a or c or g
  misc_feature 304: r=a or g
taattacctgggcatggtggtgtgcacctgtaagtcccagctacttgggaggccaaggcaggaggattgcttgaggccaggagatcaagaccagcctgagcwacatasttgaraccctgtctctacaaaaaatttaraaattavctgggtatggtggcttatgcttgtaattccagctacttgsrgargctgtgacaggaggatctcaggaatttgaggcagcagtgagctatgattgttgcacaggctggagtgcagtagcacagagtaagaccctgtctctaaatacataavtamatmavarttagataataatagtatcagaacccttgtgctaagggttatggaatggggtctagtgggagtataatttagaacaatttgaaaagggtatttgtaagatagctgggact

SEQ ID NO: 36355 - DNA, 344 bp, Homo sapiens
  misc_feature 32: w=a or t
  misc_feature 113: w=a or t
  misc_feature 114: r=a or g
  misc_feature 116: m=a or c
  misc_feature 334: y=c or t
  misc_feature 335: w=a or t
aagttcagaggttactaggtttgtaaataatwataaactgcatggataccaatggagatcaaaaaactctatctaatttaggttggggataatgataatgtgagaactgctgwrgmgtttaatttccttcatcacttgtaattcccatagtgttagtggatccctttttttttcttgtgaagaaatttgacttttcacatctagtaagtatgaactaaaagtatctgatacaagcctcaatcaatttatgaagcttattttgccgaggttaaggatgcatccatgacacagcctcaggagggcctgatgacatatgcccaaaggtggctgggaywcaggttgct

SEQ ID NO: 36356 - DNA, 177 bp, Homo sapiens
  misc_feature 15: w=a or t
  misc_feature 16: b=c or g or t
  misc_feature 96: r=a or g
  misc_feature 103: m=a or c
  misc_feature 131: r=a or g
  misc_feature 147: r=a or g
gctcactcaaggctwbcctctctcagtgggtgactgagctgtcttcagtggaagcccgaggcagatgccacgcaattctggagctggatacggctrcccacamggggaccccagcatgctggacagcagaragaccccacaggagarccggcaggacatgattgtgatgaccacccc

SEQ ID NO: 36357 - DNA, 80 bp, Homo sapiens
  misc_feature 2: m=a or c
amtgcgacacaaaggcggggattgcgtagggaaaggccctaggccataaacgggggtggggcctccccggaggccagtgc

SEQ ID NO: 36358 - DNA, 99 bp, Homo sapiens
  misc_feature 64: k=g or t
  misc_feature 67: m=a or c
  misc_feature 93: d=a or g or t
gggatccatgagtctctccttgtagggctcatgatctatttagggtagataactaggaagccakagmaacagatgcctagtagaatgtcaggdagtgat

SEQ ID NO: 36359 - DNA, 424 bp, Homo sapiens
  misc_feature 105: r=a or g
  misc_feature 386: r=a or g
  misc_feature 387: h=a or c or t
tgttgtaaatcctattgagaggaaggaaattaaaggaataaaatatcaggatagttgataggatctttaaatatttggaatcaaggaaatggcccttacctgggraggtgaagtatatgacgattatccaaggttcatgtgtgtttctgatgtgcatgctggcctttagttggggtgtgaggctgcacattctgaaccaactagtctgctgttcagatacctaggggctgtgtagtttatttcatattcgtatagggtggtctgaaatccttaggtaagtttttgggagagtctttggacatggactagaggccgttgggtgccacagaatctgtgtctggtgtttgttgtgaccaggaggctttggttggttaccagaggttagrhattagagtagttggtaaacacaccacttgtgcatttt

SEQ ID NO: 36360 - DNA, 340 bp, Homo sapiens
  misc_feature 15: w=a or t
  misc_feature 16: w=a or t
  misc_feature 101: r=a or g
  misc_feature 108: w=a or t
  misc_feature 200: m=a or c
gaaggggaacttagwwtttatttagtgtgataaaaatagtgccaactggctgggcgcggtggctcacgcctgtaatcccagtactttgggaggccgaggtrggtgaawcaccaggtcaggagttcaagaccagcctggccaagatggtgaaacctcgtctctactaaaaatacaaaaaaaacagctgggcgtggtggcamgcacccgtgatcccagctattcaggaggctgaggcagaaaatttcttgaacccaggaggcagaggttgcagtgagccaagatcatgccactgcactccagcctgggtgacagagcaagactccgtctcaaaaaaaaaaaa

SEQ ID NO: 36361 - DNA, 272 bp, Homo sapiens
  misc_feature 249: w=a or t
  misc_feature 250: k=g or t
cacatgataaatgtaatttgaatatgtgataagacaagtgaccgaccagagatcatcaagcagatgacatatgtcacctgagtagttaggaaatgctgtttgagcattaaatacacagatttaaccttatgtttatgcctcagatgatctcatacaattgtctgagatgccatatgttgaaaatagctgtattgaggtggttacttttcatatgattctcccttctctaggaatagctctaatccaatwkaggtaatactgtacctggcccc

SEQ ID NO: 36362 - DNA, 73 bp, Homo sapiens
  misc_feature 34: r=a or g
  misc_feature 54: d=a or g or t
  misc_feature 55: b=c or g or t
  misc_feature 56: v=a or c or g
agcgaggcagccgggtgcttcgcagcggagctcraggctctgtagcacccagtdbvacccagtcgcccaggca

SEQ ID NO: 36363 - DNA, 203 bp, Homo sapiens
  misc_feature 13: w=a or t
  misc_feature 91: r=a or g
  misc_feature 96: w=a or t
  misc_feature 97: w=a or t
  misc_feature 108: r=a or g
  misc_feature 110: k=g or t
  misc_feature 113: w=a or t
  misc_feature 114: w=a or t
  misc_feature 195: v=a or c or g
caagctttctctwaattctgcttaacagcagcattctcaaataataaaatttctgcttattaatatgaagctcttagagctatctggatartactwwtgttcaaatgrakaawwatgtctacaatttcttaatggggaataactgactatgaatttgctgcatctaaaatgaccccatcaattatacatgtaaavataagttt

SEQ ID NO: 36364 - DNA, 318 bp, Homo sapiens
  misc_feature 16: w=a or t
  misc_feature 60: k=g or t
  misc_feature 108: k=g or t
  misc_feature 116: k=g or t
  misc_feature 117: r=a or g
  misc_feature 123: v=a or c or g
  misc_feature 124: m=a or c
  misc_feature 136: w=a or t
  misc_feature 253: d=a or g or t
  misc_feature 254: w=a or t
ttctgtctggactagwggcactctgacatcaatttggaaattggaattaagaaaatacgkttttaaaatcgtaatacttatcagatttcactaatatttaaacacatkaggactgkrtatcavmttcaccgattgwtttgtcgacgtaatggtttacatctgtggtgctaatgataagcagaaccttgccagggacgtttgacgtggtgtggccactttacgttttcaagtctatgagaatgtctgcgcggadwcagcatagctctgtagaaatgagtggcaagcgtatgtaacctggcattttgaacccaggagctc

SEQ ID NO: 36365 - DNA, 134 bp, Homo sapiens
  misc_feature 32: y=c or t
  misc_feature 43: k=g or t
  misc_feature 51: k=g or t
  misc_feature 57: k=g or t
  misc_feature 59: y=c or t
  misc_feature 67: w=a or t
  misc_feature 69: m=a or c
  misc_feature 83: b=c or g or t
  misc_feature 88: k=g or t
  misc_feature 99: h=a or c or t
  misc_feature 109: d=a or g or t
  misc_feature 117: r=a or g
  misc_feature 120: n=a, g, c or t
  misc_feature 122: y=c or t
  misc_feature 124: w=a or t
cttttctcagtttccatttcattttttttttyctagttttggkgacttagkgatttkgycatttttwamatcaacttcatggbcttgkttttacatgghaattgcatgdacttaggrtcnaycwaataggggac

SEQ ID NO: 36366 - DNA, 160 bp, Homo sapiens
  misc_feature 15: k=g or t
tatctgggtccttckatgcagcagactgggagcctctgcacagtggctccctggggatggggcccatggccacagagctggagcccctgtgcactccggtggtcacctgtactcccagctgcactgcttacacgtcttccttcgtcttcacctaccccga

SEQ ID NO: 36367 - DNA, 220 bp, Homo sapiens
  misc_feature 4: y=c or t
  misc_feature 5: w=a or t
  misc_feature 142: k=g or t
  misc_feature 151: v=a or c or g
ctgywttaatctgaaattaatatagctgatctacctttctttcgattagtgtcaatatggtatatctttctctatccctttattttttatctctttatgtctgtacattggaagtgattcagacatcacatagttgtgtctkattttttcvacttagaatttaataaaaatttcgtactttttcatgtatcttgtaaatttttttgtatgcaggactcga

SEQ ID NO: 36368 - DNA, 207 bp, Homo sapiens
  misc_feature 96: m=a or c
  misc_feature 99: r=a or g
  misc_feature 114: r=a or g
tttgtaatctccgtaaaaataacagtatgaagcttagtacaggatatgtcacttgaaatacatgactcccaccccagaaaaattagtaaaagtggmtcraaagttcagtagtarcaattaaacagaattagaatatttttaaccaaacaaaaggcacagtaatttcctaagcagtttgctgtcacgtttaactcctttttttttttt

SEQ ID NO: 36369 - DNA, 339 bp, Homo sapiens
cctgtttgaattttttgtttttccttgcactcatagttgtattctattgtagtatatatatttgagtataaaattggttaacacactaagagttcagtttatgagatgggataaatttaaatctcaaagcaattttcaaatatactcattaagaaaatgcaagtatttatattttaaataaagtcattttccactatataccctatcacccttttattattatagacgttttctaatttccaggaaaacctcgtccaccccagtgactgatatatactctagcttgttcaacccatggcctgcaggccacatgcagcccaggacagctttgaatgcagc

SEQ ID NO: 36370 - DNA, 439 bp, Homo sapiens
  misc_feature 376: w=a or t
  misc_feature 377: w=a or t
  misc_feature 439: w=a or t
tcttaatgccttctctgttctctctgaattatacctactcagtgggagttaacgtaaaggttaaagctttacaaagtaaaactagagtttaacccccctcagcaccttcacaccaaccgctgtcaccaaaatgaaaatgtagtgctgttcaacctttaatatttacttagagtatttacataaggggagggaaatgaacttttgtctgaaacatacaacaagcggcactttgattttataaaataaatgtcaacaattgctagggcttatcaaactggggtagggagtggggtggaagtgcagttggattaaaggcccattcctgccacttcagactacaaagggttacacataataagtgccgaatttgcctaawwgcaaaagttttcttggtgctttctaagtcacaacaggggagggggaaagctgtcgtttattw

SEQ ID NO: 36371 - DNA, 195 bp, Homo sapiens
tttgtgactctcaccagcacgcctaagggccccacgaatcgctggtgtagagcgtgtgtgttttcataacatgaagggagaagagcagttgcgacagttgtccctgagcaaacatttgcatccagctgggcacgcgtgcctccccaggctagggcagcgggtgctcaccctgccctcttcctgttcacagcctcc

SEQ ID NO: 36372 - DNA, 170 bp, Homo sapiens
tcatttcctgagcctggccaggcatgttctcaaaggataggaacttccgtctcaaggccatcagcctggagggttggtgggaacttgtggggcagaagttctggggcgagaagccactcaggcttgggttttgttcagatgtaggggaccccctctggtcatccagcaac

SEQ ID NO: 36373 - DNA, 433 bp, Homo sapiens
  misc_feature 384: r=a or g
  misc_feature 432: m=a or c
ttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagragcaagaggtcccgagtcccctcctagtctttcatcctgaatttgcama

SEQ ID NO: 36374 - DNA, 308 bp, Homo sapiens
  misc_feature 116: n=a, g, c or t
  misc_feature 117: b=c or g or t
  misc_feature 237: n=a, g, c or t
  misc_feature 238: n=a, g, c or t
  misc_feature 302: k=g or t
tttgtcctttttaaattcttggaggcccttcataacatggaacacaggatgggcaaacgtgcttcttatagtgtaggttagatttagcaccttttgacaaagggccttgtttcctnbgcagtttaaatttagatccactgagaatctgagaaattcagtaatgaaagggtaactttggagtttcctcttttggaagctttccttattaaattctattaatgactctgttagacttgnntcccatcttacacaagagattccagaatagcaacttgaattgcttcttagtccctcttacgaakcactca

SEQ ID NO: 36375 - DNA, 227 bp, Homo sapiens
  misc_feature 116: n=a, g, c or t
  misc_feature 117: v=a or c or g
  misc_feature 177: n=a, g, c or t
tgcccaggctggtttcaaactcctggcctcaagcagtcttcccacctgagccttccatattactgggattacaggtgtgaacaaccacatctggcctatttattttttgtttattnvtttatttattttgagacggagtctcactctgtcgcccgggctggagcgcagtggcgcgantctcggctcactacaggctccacctcccgggttcgcgccattctcctgga

SEQ ID NO: 36376 - DNA, 147 bp, Homo sapiens
  misc_feature 51: r=a or g
  misc_feature 112: w=a or t
  misc_feature 124: r=a or g
  misc_feature 128: w=a or t
cctttttgctgtaggcccgggtggttgctgccgaaatgggcaagttcatgraacctgggaaggtggtgcttgtcctggctggacgctactccggacgcaaagctgtcatcgwgaagaacattgrtgawggcacctcagatcgcccca

SEQ ID NO: 36377 - DNA, 149 bp, Homo sapiens
  misc_feature 60: s=g or c
gcacttgggctgcagctcgcaaccagaggcagtgtctctcagctctcggaaggaccgcasagaggcaaccgcggagtaggatgctctgcggggcgcccagagccgggggcgcttgaagcagcttcggggactggggcaaccgggcagtc

SEQ ID NO: 36378 - DNA, 83 bp, Homo sapiens
  misc_feature 15: r=a or g
  misc_feature 72: y=c or t
gtctttttctttccraaaaattgcttttagatctacagatttcatcagatttgggtttgatttttttttttyccccaaaaaaa

SEQ ID NO: 36379 - DNA, 129 bp, Homo sapiens
  misc_feature 17: d=a or g or t
  misc_feature 69: m=a or c
  misc_feature 75: w=a or t
  misc_feature 94: r=a or g
cctactttatagatggdttttacttaccagcagaccattttgtactttatttgagtctattcccaggamtgcatwaatttctccccacataagragacccacaagtccacttaatctgtggaggtgagt

SEQ ID NO: 36380 - DNA, 308 bp, Homo sapiens
  misc_feature 169: k=g or t
  misc_feature 174: y=c or t
  misc_feature 179: m=a or c
  misc_feature 191: s=g or c
  misc_feature 193: w=a or t
  misc_feature 199: k=g or t
  misc_feature 209: y=c or t
  misc_feature 288: n=a, g, c or t
  misc_feature 305: r=a or g
attaaaaatatatataggtcaattttggtctgaaatccctgaggtgtttttaacctgctacactaatttgtacactaatttatttctttagtctagaaataggtaaattgtttgcaagtcactaataatcattagataaattattttcttggccatagccgataatttkgtaaycagtmctaagtgtatasgwattttkgccacttttycctcagatgattaaagtaagtcaacagcttattttaggaaactgtaaaagtaatagggaaagagatttcactatttgcntcatcagtggtaggggrggc

SEQ ID NO: 36381 - DNA, 59 bp, Homo sapiens
  misc_feature 15: w=a or t
  misc_feature 16: d=a or g or t
gacttggaaatgtgwdcgcaagaagcaggcttgatttttttttctccccccttctctct

SEQ ID NO: 36382 - DNA, 271 bp, Homo sapiens
  misc_feature 136: w=a or t
  misc_feature 156: d=a or g or t
  misc_feature 203: r=a or g
  misc_feature 204: w=a or t
aaaacatttataaagctgggcatgctggtatacacctatagtctcaactacttgggagagtgaggcaggaggatttcttgtgcccaggagtttgagtctagcctgggcaatgcaatgagacctttatctctaaaawataaaacaataaaaatatadaatttaaaaaatttttctgcttttcaatttttctggaaagaaatatrwcttaattaaaggaaaagaatttaaaagcaaggctgatactcgagcattttgaggtcatatttgatgt

SEQ ID NO: 36383 - DNA, 89 bp, Homo sapiens
  misc_feature 15: k=g or t
tgtaccttgcgcttkcttagtacatggtactgttctaggtggtttaggtgtgctatttattttatatttattcctaaaaacagtctcat

SEQ ID NO: 36384 - DNA, 79 bp, Homo sapiens
  misc_feature 59: y=c or t
cttttctcagtttcgatttcatttttttttttctagttttggtgacttagtgattttgycattttttacatcaacttca

SEQ ID NO: 36385 - DNA, 195 bp, Homo sapiens
  misc_feature 24: m=a or c
  misc_feature 118: w=a or t
  misc_feature 128: m=a or c
  misc_feature 187: r=a or g
  misc_feature 188: m=a or c
cctgtttttagtgtttaactagcmaactcctgtctgggtgttcttttaaaaagtaattataccatttatgatacacccatttaagtcccaacagctattccctcttggacctcatgtwgtggggctgmatttgcttctgttattattatttgagtaaaagaacgtgtgtatgggtcgcctttatatrmctgccta

SEQ ID NO: 36386 - DNA, 91 bp, Homo sapiens
  misc_feature 41: m=a or c
  misc_feature 57: y=c or t
tggagaagcaaggaaggcggaggtcatgatggagggagtamagtggcatgaagaggygatctttaaaagataggcttttgatggtacgagt

SEQ ID NO: 36387 - DNA, 281 bp, Homo sapiens
  misc_feature 15: r=a or g
  misc_feature 44: s=g or c
  misc_feature 102: k=g or t
  misc_feature 119: r=a or g
  misc_feature 120: v=a or c or g
  misc_feature 134: r=a or g
  misc_feature 136: r=a or g
  misc_feature 157: s=g or c
  misc_feature 158: d=a or g or t
  misc_feature 164: m=a or c
  misc_feature 172: h=a or c or t
  misc_feature 173: n=a, g, c or t
  misc_feature 189: r=a or g
  misc_feature 254: m=a or c
cgatgctgatcctcrtaggctccctggagctctgatcctggaasccctccctctgcgccgcagctggacgccacctccgatggacacagccagccccttcckgctgccaaggtggcctrvacactgtgccagarartggctggttttaaatacctasdttaaamagtgccchntttgtaggaggtaggratattttatattctgccgcaggaatagaacccacgcaaggattttctttaaattgagaggcaccmggcagtaacttccatgaatgacactga

SEQ ID NO: 36388 - DNA, 256 bp, Homo sapiens
  misc_feature 127: n=a, g, c or t
  misc_feature 168: n=a, g, c or t
ccatactttatttgggtttcattagtttttctactaatgtaatttttctgtgccaggatccagtccaggataccacattacatttatttgtcatgccttcctatttcccactgatctgtgatagctnatgagtcatttcttgtctgtcatgactttgatggttttgangagtattgaccaggtattttgtagaatatcactcagtttgagtttgtttcatgctttcctcatgattagattcagattatagtttttt

SEQ ID NO: 36389 - DNA, 111 bp, Homo sapiens
  misc_feature 8: y=c or t
  misc_feature 21: y=c or t
agtcaacyatataaacataayagtgaaagagaaatttcactatcaaaagatttgcacaccataagaaaaacattaagttacatagctactgaactaggaggactgacaaat

SEQ ID NO: 36390 - DNA, 108 bp, Homo sapiens
  misc_feature 15: r=a or g
cagaatgtgtttatrttaagaaatttacttgaatattgtacaaattaataaaatttgaatacagaaagggtttttgttcttatgaatgctaactttaatgttttagaa

SEQ ID NO: 36391 - DNA, 174 bp, Homo sapiens
atatataccactgtaccacttaaaagaaaactggaccaatcttattttttattggaaccttgctctgttttacaaagagttggaagcaacttaggaaaattcatacaaccaaaaggataaatgtaggctaagggagtcgggtgaaaggaaaatatgggtaagaagacgagccaa

SEQ ID NO: 36392 - DNA, 310 bp, Homo sapiens
tatctgctttagattctcgttaattgtggtttcctttgcatttcagtgttctaatcttaggcgcttcaggcggagttggtacttttgctatacaggtaaaaccattttttaatcttgtgaataggaggattttgtttgcatgaatttataaattaagatacattatttctccttaaaagctgagagaaaggtaggtctggtaaatgtactgtaatttcagcttgttctgtaagaggaaaatattctttttttattagaaaaaattattttttagagatggagtcttgctgtgtcacccaggctggaggat

SEQ ID NO: 36393 - DNA, 218 bp, Homo sapiens
  misc_feature 127: d=a or g or t
  misc_feature 129: w=a or t
  misc_feature 159: d=a or g or t
cttctcttttatagctttatttagttttatagatttaaccactttttttttatactttatgttctgggatacatgtgcagaacgtgcaggtttgttacacaggtatacatgtgccatggtgatttgdtwgcactcatcaacccgtcatctaggttttadgccctgcatgcactaggtattggtcctaatgctctccctccccttgcccctgacccctt

SEQ ID NO: 36394 - DNA, 434 bp, Homo sapiens
  misc_feature 405: k=g or t
caacagcttgataataaaaggagccgtttgtcaagagacagtcctgtaagcgctttttaacctggtagactgtgcatgtaagggcaggcaggttacaaatgcgaatccccatagccagcacactctacatacagcagattcttaagccatctgtgtactctttttaacactgtactgaagtccacttaagtcagagttcaacaaaatgaatgaatgtaatcccaggactatggaacttctctgtgattacatagcacagagaactacggaatcattttctggaagaatgcaccatgcgattatgctccatgtggaattggtatatataaatgttggtagactgtgaggatgaggttgacaggttgatctgagtagagaccctaggaggaaccgaggatactaackagttttgttgttgttactgttttgcagtt

SEQ ID NO: 36395 - DNA, 435 bp, Homo sapiens
  misc_feature 273: n=a, g, c or t
  misc_feature 274: n=a, g, c or t
  misc_feature 275: n=a, g, c or t
  misc_feature 337: b=c or g or t
  misc_feature 338: r=a or g
  misc_feature 404: m=a or c
  misc_feature 405: s=g or c
  misc_feature 406: d=a or g or t
  misc_feature 407: k=g or t
ctactaaaaatacaagaattggcccggcgtggtggcacacacctgtaatcccagctactagggaggatgaggcaggagaatcgcttgaacctgggaggcagaggttgcagtgagccaagatcgtgccactgcactccagcctgggcggctgagcgagactccatctcaaataactaactttcattactgtcaatagaacaaagtgcagattccttcatttagcatcgaaggccctctattagctgaaattaggtaaggagttttccccactannnccttactcaccattcagttaatcatgagctttccctatttgactaaactattcagtgttctbrgactgtctatcgtcttgcatttccccagttcaacttccttcaccaagttctacttaatcctttctmsdkttcatgaaacaatcttttcccacccata

SEQ ID NO: 36396 - DNA, 91 bp, Homo sapiens
  misc_feature 15: w=a or t
tacaattagttaaawaaaaatacgcatgctaaaaagaggtttatattcttatttttctcctaaattgcaggtatatactttaaaaatctta

SEQ ID NO: 36397 - DNA, 56 bp, Homo sapiens
  misc_feature 15: d=a or g or t
  misc_feature 16: y=c or t
cataattagcatctdycattatccccaaatcttattttattcattgacttgaaatt

SEQ ID NO: 36398 - DNA, 215 bp, Homo sapiens
  misc_feature 16: k=g or t
  misc_feature 17: r=a or g
  misc_feature 122: m=a or c
  misc_feature 128: r=a or g
  misc_feature 134: w=a or t
  misc_feature 137: n=a, g, c or t
caacccctgcacattkrccaatctacacaactgagcactggagcgaatgaggtgagtgagggcccagaaagttgaagcaggaacgatccgagccttcagttaatcctaacgtcacctctaamgtttgrggtaawgancgtttcaggaaaccaagggggaaccaacgctcagcacagcagagaaagacaccaagctacgggacccgccgcgcctcc

SEQ ID NO: 36399 - DNA, 240 bp, Homo sapiens
  misc_feature 107: n=a, g, c or t
ttcactgaatgtactaggtgattataaaaattagatttttcatcatatatcagtacttcacctaatatctatgcaagccatttttccaacacaggtgatagaactangttatttaaatgagcatttttagatgctgtcttagtttgctattatgtgagctatattgtctattaaggtaaatagttgcctgtaattatctattgactactaatactttcatcttaagttcagggggccaaa

SEQ ID NO: 36400 - DNA, 69 bp, Homo sapiens
  misc_feature 15: d=a or g or t
  misc_feature 33: s=g or c
gaagcgaatttatgdaaaaagtaatccaaagtsgaaagatcgtaattacaaggtttgattttttttttt

SEQ ID NO: 36401 - DNA, 401 bp, Homo sapiens
  misc_feature 117: w=a or t
  misc_feature 118: w=a or t
  misc_feature 136: d=a or g or t
  misc_feature 339: d=a or g or t
  misc_feature 340: n=a, g, c or t
  misc_feature 341: b=c or g or t
tgttatcatatgttacaaatcattgctaaatccaaatgtaatgaaacttctcccctatgttttcttcaggtagttttatagtttcaggtttatattttttgttttgttttgtttgtwwgttttgggatgaagtttdgctcttgtttgcccaggctggagtgcagtggtgcagtctcggctcaccgcaacctctgcctcccaagtagctgggattacaggcttcaagcaattcttctgcctcagcctcccgagtagctgggattacaggcatatgccaccatgccgggctaattttgtatttttagtggagaccgggtttctccatgttggtcagcctgdnbtcgaactcctgatctcgtgatccgcctgcctcagcctcccaaggtcctgggattacaggc

SEQ ID NO: 36402 - DNA, 361 bp, Homo sapiens
  misc_feature 292: w=a or t
  misc_feature 300: s=g or c
  misc_feature 301: m=a or c
  misc_feature 310: w=a or t
  misc_feature 317: w=a or t
  misc_feature 322: r=a or g
  misc_feature 355: m=a or c
ccgaacatttgcttactcacgggcctctacggtgagtgtcctcagcttcaccttccacgactgcacacctgggtacttaacctgttcttcagtcaccttcctaagagaaatctggttggcccagctaattaccgttgtccttgtttcggaagaggctgtcaggcctggctcacgctggtcattggccaacctgtctgttcccttccctgggatctggtgcccatccctgtccagtcacctgtgatacagaacaggtgtgcccgagactgctacctcaccagggccagggagwaagagggsmaggcaccawaccaaawacaarcctggtacgtgtgccatagcttgctttgtgcamccctga

SEQ ID NO: 36403 - DNA, 109 bp, Homo sapiens
  misc_feature 16: s=g or c
  misc_feature 17: k=g or t
  misc_feature 44: d=a or g or t
  misc_feature 84: n=a, g, c or t
ggccgggcgcggtggskcacgcctgtaatcccagctctcagggdggctaagaggcgggaggatagcttgagcccaggagttcgngacctgcctgggcaatatagcgaga

SEQ ID NO: 36404 - DNA, 207 bp, Homo sapiens
tatgcatatgactcatcaatatatctgtatttccatatagaaagaacacttagaccgggcacagtgactcacgcctgtaatcccggcactttgggaggccggggctggcggatcacttgaggccaggaagtcaagaccagcctggctaacatggcgaaaccctgtcactactaaaaaatacaaaaattagcctggtatggtggcgca

SEQ ID NO: 36405 - DNA, 215 bp, Homo sapiens
cttaaatgtaataaaaatgtagcccctcacattagcctcatttcaagagccacatgtggctaccgtattgtaagcagagctcaagaacattcagcaatattgtgagagtggctaccatattgagagcagagctctagaacattcccttatcccagaaagttctcttggacatgctgctcaaggtggtgaactctgagatctccagtccccccgca

SEQ ID NO: 36406 - DNA, 108 bp, Homo sapiens
taagccatgggaattgatggagtcctctaggtagagtttaaagaatgaaaagaaaagaaaatccaagacgtctttggaccccaaacattgagacgtttcccagaggag

SEQ ID NO: 36407 - DNA, 73 bp, Homo sapiens
  misc_feature 6: n=a, g, c or t
  misc_feature 12: w=a or t
  misc_feature 30: w=a or t
  misc_feature 47: w=a or t
  misc_feature 52: y=c or t
  misc_feature 65: y=c or t
cttgcngaggcwggggcaaccaccgcaggwcgagacagcaggcggcwcaagyggacagccgggayggcagagc

SEQ ID NO: 36408 - DNA, 92 bp, Homo sapiens
tactatgttctagagactgtctcaggttcttcacttatgttagtccactgaatcctctaatagccctatgggatatatgctgttatgatggc

SEQ ID NO: 36409 - DNA, 107 bp, Homo sapiens
  misc_feature 63: m=a or c
  misc_feature 97: w=a or t
actttgaacttgagagagatgatttagggtatctggtggaagaaatttctaagcagcaaagcmttccagaggtaacttgggtgctgttaaaggcatwcagttgtaaa

SEQ ID NO: 36410 - DNA, 320 bp, Homo sapiens
  misc_feature 120: m=a or c
  misc_feature 121: b=c or g or t
  misc_feature 125: r=a or g
  misc_feature 157: y=c or t
  misc_feature 176: r=a or g
  misc_feature 177: r=a or g
  misc_feature 192: w=a or t
ctctcccgctcctttaaacccccctgcatcgtagagagcgggctggattctctgtggtgctgatggaggagggggagcaggttgaaacaatcgagtgggcgcgccaggactccccagctmbtggrcggggaagggagggggagcccctgttctgcgyagggaggcggcggggctgrrgggcccccggaacgwggaagaggcaggggtgaccgctagaataggaaagtgctcacccccgggaggcaaaatttcgttcagatcgcacattaattggagatatctgattaattccagcttctgatgactataaaatggcgatt

SEQ ID NO: 36411 - DNA, 67 bp, Homo sapiens
  misc_feature 15: m=a or c
  misc_feature 50: s=g or c
caaatgcctttcctmaagaatctgttttttcttccccagtcttccctgtsgggcattgttcagcagc

SEQ ID NO: 36412 - DNA, 115 bp, Homo sapiens
  misc_feature 44: k=g or t
ggccgggcgcggtggctcacgcctgtaatcccagctctcagggkggctaagaggcgggaggatagcttgagcccaggagttcgagacctgcctgggcaatatagcgagaccccgt

SEQ ID NO: 36413 - DNA, 287 bp, Homo sapiens
  misc_feature 15: d=a or g or t
  misc_feature 110: k=g or t
  misc_feature 115: s=g or c
  misc_feature 121: h=a or c or t
  misc_feature 123: s=g or c
  misc_feature 126: k=g or t
  misc_feature 137: r=a or g
  misc_feature 168: d=a or g or t
  misc_feature 263: h=a or c or t
aacaccctgaatcgdgctccacgcaggagatcggtgaggagctgatcaacggagtcatctactccatctccctgcgcaaggtgcagctgcaccacggaggcaacaagggkcagcsctggghtsggktatgagaatgrgtcggccctgaacctttatgagacttgcaadggtgcggaccgtgaaggctggcacgctggagaagctggtggagcacctggtgccagccttccagggcagcgacctctcctacgtcaccatcttchtgtgtacctatagagccttcacca

SEQ ID NO: 36414 - DNA, 106 bp, Homo sapiens
tgtaggaataaatggtataaacgtagagaaaatcatgggctatctgcagaattgtatgtaagtaataaagcaacagcagaaccagttaattactcatgggcaaatc

SEQ ID NO: 36415 - DNA, 197 bp, Homo sapiens
  misc_feature 75: r=a or g
  misc_feature 108: n=a, g, c or t
  misc_feature 109: v=a or c or g
  misc_feature 120: r=a or g
  misc_feature 121: r=a or g
  misc_feature 122: m=a or c
  misc_feature 132: r=a or g
  misc_feature 135: w=a or t
  misc_feature 136: w=a or t
  misc_feature 149: m=a or c
tcaaaggacgttatagtgaagaatcataagatttttggggaggaaacacctatagagagaaagttagaaaaagarctaataatttctggcctgttcagtggctcacgnvtgtagtctcarrmactttggggrggwwgaaggcaggcggmtcacttgagatcaggagttcacgaccagcctggccaacatggtgaaac

SEQ ID NO: 36416 - DNA, 102 bp, Homo sapiens
  misc_feature 16: b=c or g or t
  misc_feature 22: m=a or c
  misc_feature 29: r=a or g
  misc_feature 53: r=a or g
  misc_feature 65: r=a or g
  misc_feature 85: m=a or c
gttcatcttattcgcbagccamagtaggracagcgtaagaggagagagacacrttcagcagccaraggactcggtggaaagagcmgaacaccatagacaata

SEQ ID NO: 36417 - DNA, 243 bp, Homo sapiens
  misc_feature 150: w=a or t
ttgcaaataacaagactttatttttaagggctgaatggcatttcattgtgtacatataccacattttctttctccattcacctactgatgaacactcaggttgattccataccttagttattatcagtaatcacttccttccctttcatwtgtgtttgttttgttttgtttgagatggagtctcattctgtcgcccaagctggagtgcagtggcgcggtcttggctaacagcaacctccgcct

SEQ ID NO: 36418 - DNA, 102 bp, Homo sapiens
  misc_feature 17: d=a or g or t
  misc_feature 18: k=g or t
  misc_feature 26: m=a or c
  misc_feature 68: r=a or g
  misc_feature 69: k=g or t
  misc_feature 70: v=a or c or g
  misc_feature 71: d=a or g or t
aagattggacgccccgdkttaatagmataaaattatcatgatttcttcttccatctataacttaaccrkvdaacctttaaaaaataccatacatatttatga

SEQ ID NO: 36419 - DNA, 289 bp, Homo sapiens
  misc_feature 129: w=a or t
tgaaatctggatttgagtgctgagttgaccattgcagccgtggtatgattctggtctctgcataaagtaaccaagctttgttttctggtgtgatacctttcctgtatttttattacagttcagccatawttagttttcttgttttaaaccaactcaagataagaaatttaactttttttccccctgaatatcaaagtgatactgtctgttacagaaaattctgaaaatatgggaaggtataaagaagaaatttcaaaattaccagtaatccagtcactcaaccagcagc

SEQ ID NO: 36420 - DNA, 103 bp, Homo sapiens
  misc_feature 38: s=g or c
  misc_feature 52: r=a or g
  misc_feature 53: r=a or g
  misc_feature 91: v=a or c or g
aacatccattttacttgtggggaaatagattcgggaasctggttcaggcctrrggaaataggagagcctggaggctgtgtggactcctgcvtcccccaattca

SEQ ID NO: 36421 - DNA, 136 bp, Homo sapiens
  misc_feature 130: r=a or g
cagtcagttaggcaaagagaacaaactatattcacctgccaggtatgcagatgcattatttaagtcatccgatatcagatcagccagtttagaggacctgtgggaaaatctgagtttaaagcctggccarctccct

SEQ ID NO: 36422 - DNA, 60 bp, Homo sapiens
  misc_feature 17: w=a or t
aattgtcactgatgttwattattcccctcgatgcccaggggctctgatagcagcactggt

SEQ ID NO: 36423 - DNA, 458 bp, Homo sapiens
  misc_feature 140: d=a or g or t
  misc_feature 179: m=a or c
  misc_feature 180: n=a, g, c or t
  misc_feature 191: k=g or t
  misc_feature 192: n=a, g, c or t
  misc_feature 438: r=a or g
caattttgttgatcctttcaaaaaaccagctcctggattccttgattttttgaagggttttttgtgtctctatttccttcagttctgctctgatcttggttatttcttgccttctgctagcttttgaatgtgtttgctcdtgctcttctagttcttttaattgtgatgttagggtgtcmnttttggatctkncctgctttctcttgtgggcatttagtgctataaatttccctctacacactgcattgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagctctagtttgtttgcactgtggtctragagatagtttgttataatt

SEQ ID NO: 36424 - DNA, 365 bp, Homo sapiens
  misc_feature 239: n=a, g, c or t
  misc_feature 241: w=a or t
  misc_feature 359: r=a or g
taccacaaattatgcagtcgagtttcccacatttgggggagtcgcaggggtcggcacatccggagtgcaatggatgggcctcgccctgggaaaaccaccttcgtgatcatggtatctcccctgccagtgactaccttgcacaacggcatgtggcagaagtgatgtccagggtctcccgaggctgggtcggaggcatccttacagctcccatctgggtctaccggaatcgtcttggaggntwgcgccgccatggaagaaggctgactacgcaggctgccgtgtcgtgaggaagcccgaggctttgtggagagaaatgcatggaaacggtttcagtccccagccgagaccctaggcatcarggagca

SEQ ID NO: 36425 - DNA, 134 bp, Homo sapiens
tacatgaatggcacaggtccaattttagtgttccttctctatttggaggagttctgggccctcttcttttaatccttcaccacttaccattggtgctcatgtattcaaataagcttctcctagaaggcggccct

SEQ ID NO: 36426 - DNA, 202 bp, Homo sapiens
  misc_feature 132: r=a or g
  misc_feature 149: r=a or g
tgtttggaaaagcatctgttcagccacgcgtggctttctctactgagaatacaaaattagctgggcgtggtggctcatgcctgtaatcccagctactccggaggttgatacagaatccctcgaacccggaargcagaggttgcagtgaracaagatcacaccattgctctccagcctgggcaacaagagcaaaactccatct

SEQ ID NO: 36427 - DNA, 74 bp, Homo sapiens
ctcattgaactcgcctgcagctcttgggttttttgtggcttccttcgttattggagccaggcctacaccaccac

SEQ ID NO: 36428 - DNA, 339 bp, Homo sapiens
aagaaggatcattgaatggatctcgtgatatttcaggctttaaacgtaaccgagaggcagcaatgaacaatgcctcgtcacagctaataccatccagcgagttggctttcttttgcatctggatctattacaccgtgtttttctctttcactttcacaggagacaaaatgcacaaggtttaggcagaaagcgaagtttccaggaaaagcagatgctggtgtttgtttttaaaagtagaatgaccagagtctttctattgccagcaacaataatgtcgttttaaaattccttctgatgcacttatatagtactgccagccctcgccctcccacccccacc

SEQ ID NO: 36429 - DNA, 285 bp, Homo sapiens
  misc_feature 58: w=a or t
  misc_feature 107: m=a or c
  misc_feature 120: k=g or t
  misc_feature 121: w=a or t
  misc_feature 133: w=a or t
  misc_feature 135: w=a or t
  misc_feature 143: y=c or t
  misc_feature 144: m=a or c
  misc_feature 145: m=a or c
  misc_feature 148: m=a or c
  misc_feature 159: w=a or t
  misc_feature 164: r=a or g
  misc_feature 168: v=a or c or g
  misc_feature 169: r=a or g
  misc_feature 239: w=a or t
cataaacaaaaagtgctagcagagtgattccaaaacaccagatgctttcaaacactgwcatccctataattatttttataatatttctatttgtttctaattataamactagtacatgckwattttggacaawtwggaaaagymmagmcaaatagaaawatgaraacvraacatatcattgttattcttagaacttttttcagccactagattcagtactaggctcatgtgagattttwagcacagagttcagagacatggcatgaaacctgtatgcatagaagc

SEQ ID NO: 36430 - DNA, 72 bp, Homo sapiens
  misc_feature 45: r=a or g
  misc_feature 54: v=a or c or g
taaggaatgcacaaattgaaaacacactcaaaagacaaacatgcragtaaagavaaaaaaaagaaagacttt

SEQ ID NO: 36431 - DNA, 275 bp, Homo sapiens
  misc_feature 215: s=g or c
ttgaattatcatctatgagttactgaatggagaaaatgaatctctttcaaatgaatagaaagatggatgaggatctttgggtgactcttttttgttttgaaaatttaaaacagcttcacaggtagaaaaaaataataaaattaacccccatgtgtgcattactaagtgttaacagttacaatatttaccaaagttgtttcatttatcatttcctsatacctgatatggtttggctgtgtcctaacctgaatctcatattgaattgtagcccccat

SEQ ID NO: 36432 - DNA, 201 bp, Homo sapiens
agttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggacaa

SEQ ID NO: 36433 - DNA, 318 bp, Homo sapiens
  misc_feature 303: b=c or g or t
tgaactaaagtattttaatggattgtgttttatagactatagtctttcagaagaagcaaacaagatcttctggaacttgatcaagctaaagtgaaaatgtaaagagatgacagtatgattagattttgttgtgttttctttaatggtgaagagcaatagcataatttctttaacagaatgggctcaggcactgtgcagacttccttctggaacactgtctatgtaagaaaagcatctggcatgttttacatagatgctgtatggaaattatgatgatacggatcacatgaatttctttgactbatggccggttttttt

SEQ ID NO: 36434 - DNA, 188 bp, Homo sapiens
  misc_feature 16: r=a or g
  misc_feature 139: k=g or t
  misc_feature 165: w=a or t
  misc_feature 167: y=c or t
  misc_feature 169: k=g or t
ttttcttacatactgrgcaactgtctgtaacccgtttggccggggtataaattcctgtgcacccataaactctgaggactgcgtcacacatggcgtggggcccccagtgggtcccttgacgcagcttgggaacaacatktcgctcatgaggggtttggataacawtyckctctggtctggcagtatcc

SEQ ID NO: 36435 - DNA, 109 bp, Homo sapiens
  misc_feature 68: m=a or c
agaagcgcttccgagggagcggaggggagaccctacaaagccaaggaagggcgggagtggaactgggmtcagtaaaacgcgataggtcattataactcaccccccttga

SEQ ID NO: 36436 - DNA, 358 bp, Homo sapiens
  misc_feature 151: k=g or t
  misc_feature 152: s=g or c
  misc_feature 169: k=g or t
  misc_feature 220: k=g or t
atttcaatgcctgtgtatccagtgtatagtgattaaatctggataattgggatgtgcagcacctcaaacatttatcattttgtgctgtgaacattcgaaatcttctagctttttgaaaatatacactaaaattactgttacccatagtcaksctgcattgctgtacaakactggaatttattcctctcttctagctgtgattttgtatctgttaaccaakctctcctagcctctaataaccacaattctactctctacctctatccgctcatgttttagctcctatatatgagtgagaacacagtatttatctttctgtgcctgacttagttcacttagtataatgtcctccaggcca

SEQ ID NO: 36437 - DNA, 421 bp, Homo sapiens
  misc_feature 133: r=a or g
  misc_feature 140: y=c or t
  misc_feature 145: w=a or t
  misc_feature 382: h=a or c or t
  misc_feature 387: d=a or g or t
actatactataaactatgtgctaatattgtctaaaaacaatgtaattaccctaattaaaaaattctttattggtaaaagtgctaagcatcatttaaacttttagcaagtcctgatctttttgctggtctaagrttccgcytcaawattgatggcaactggcttatcagggcagtgtttaccgaagttggaatggctgtggcaatttcttaaaataagacaacaatgaggtttcccacattgattgactttttttcataaaatatttctctgaagcacataatgttatttgagacattttacccacactggaatttctctcaaaattgaagtcagtattctcaaacactgccagtgctgctgcttttgcaactaagtttatghaatadtcaaaaatcttcatgttctcatttcaacaatgtt

SEQ ID NO: 36438 - DNA, 91 bp, Homo sapiens
  misc_feature 39: w=a or t
  misc_feature 40: w=a or t
  misc_feature 58: k=g or t
  misc_feature 62: m=a or c
  misc_feature 77: r=a or g
agctctgggcgcagaggtttctgggagccaagagtggtwwtggcgtctgtatgatctkcggmgcctgctgcatcggrcctcggccagtcat

SEQ ID NO: 36439 - DNA, 395 bp, Homo sapiens
  misc_feature 103: m=a or c
  misc_feature 104: w=a or t
  misc_feature 125: n=a, g, c or t
  misc_feature 223: v=a or c or g
  misc_feature 318: k=g or t
  misc_feature 319: k=g or t
aggatgaactccgttttccactggaaggtctcaagaggctaaaggcaccccacgggcttctccccgaggaagggactgaggacagaggagggccacggttgcmwtgaggacagctccggctcaanagcgtccctggacccttgactctcagcttgtcttgtcttccttaataaatttcagtttgcgggggaggggagagggatagcattaggagatatacctvatgctaaatgacgagttaatgggtgcagcacaccaacatggcacatgtatacatatgtaacaaacctgcacattgtgcacatgtaccctaaaackkaaagtataataataataaaattaaaacaaaataaataaatttcagtctgaacaaatattctcactttcgggggaca

SEQ ID NO: 36440 - DNA, 251 bp, Homo sapiens
  misc_feature 109: w=a or t
tgcttggatattggggtccaacagacctggctgagttcaatgtcagctttttctttgactgtgagtgatttacttaacctttttgagccccagttttctcaacttagawagactattttgaggataaggaagaagttggtgacgattagaaatgcagtcacgaacatagtggactcctttgtataaagaatcagacaatgcatgcttatcactgcagaatctggtattatgggtaaccattaggggaaaga

SEQ ID NO: 36441 - DNA, 85 bp, Homo sapiens
ataaaattagaaattaaactcacctttggcaagtcctcctgaccagggatgggtcctcatgttagtctgtaatgtgaagatatga

SEQ ID NO: 36442 - DNA, 120 bp, Homo sapiens
  misc_feature 88: k=g or t
cctattggctttttacatttaaattatggagcacttcatcatataaaaaacttcaattatatttaaacagtaagtctttggatttttktgccttgtaatttccatattacataataatga

SEQ ID NO: 36443 - DNA, 139 bp, Homo sapiens
  misc_feature 15: k=g or t
gctggggctgggggkgtttgttgggctggtgagttttcgaggtgactgtgctgtgctcggtgaggggacgcccagagagccctgacccggggtcactccgtcgccgtttctcctcttgtctacgtgctggacccggtgc

SEQ ID NO: 36444 - DNA, 76 bp, Homo sapiens
  misc_feature 16: y=c or t
  misc_feature 62: m=a or c
atttctggttttcctycttttgaataagaagtcagcagtcattcttatcttcctttctgtgmacatgatggttttt

SEQ ID NO: 36445 - DNA, 91 bp, Homo sapiens
ttgcattttgattgttcaaccatgggtttagtcacaatgacaaaggttacccaggtaccagcaccccactcccagctgcaacccagggaca

SEQ ID NO: 36446 - DNA, 149 bp, Homo sapiens
gaagctgacttttaaggcattggcttttaaattaatacatatatccaaggatatgttatagctgcagtgtttgaaagccaaaggatttaagagttttgttgttgttaataaaaggaatactccttttccttttggatcatagcttaaca

SEQ ID NO: 36447 - DNA, 291 bp, Homo sapiens
  misc_feature 121: s=g or c
  misc_feature 129: r=a or g
tatgctgccaaaaagtacattgtccctcaccttgccagagcctgtgttaatttcctggagaccagcctgagtgccaagaatgcctgtgtgctcctctcccagagctgcctgttcgaggagscagacctracccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggcaaaa

SEQ ID NO: 36448 - DNA, 355 bp, Homo sapiens
  misc_feature 122: d=a or g or t
cttctcaacagttaatgatgtgggttgtatactggggacctgtggaaaaccatttctaatggtggagtgttaaacaagtggggggccgctgtgtgccactgagagcctggcctctgctctgdcttctgtgcctttggagagagacccccatccccaaagatggtctccctctgggtggagttttctctggaagctgcctttcagtgatatgcagatatctccacctacttcccctggtctagccccagtgatagttgtttattgcacgcagtctcaagggaaaattgattgggtatttgaccactggtaagggcacacatcaagtttggcatttatattgacttaagacctggac

SEQ ID NO: 36449 - DNA, 74 bp, Homo sapiens
caattcttttggattttctacataaataataattttatcttcaaacaaagataattttatttcttccctcccta

SEQ ID NO: 36450 - DNA, 454 bp, Homo sapiens
  misc_feature 400: b=c or g or t
tccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttcbatctaggaatagttactaatgtatttgagatacagcataccaaattttaaagta

SEQ ID NO: 36451 - DNA, 111 bp, Homo sapiens
  misc_feature 11: s=g or c
  misc_feature 99: w=a or t
acttgcggaastgtgtctgcgcgagttcccgtgcggtgccggcagctggaataagtcgcgctttcttcctcaaacttggcgaacttggagggtgcttgwccccagagagga

SEQ ID NO: 36452 - DNA, 240 bp, Homo sapiens
  misc_feature 176: d=a or g or t
catcttgggagaagtaacttactgtatggttattcccacagtgtgagtgtcatcatctaactgccctcatgcttctttttaggccagaaaattagtccagaaggaaaagctaaaattcagcttcagctggtcctacatgcaggggacaccaactaaccttccatttttccaatgadagcacagcagtgaaagagcgagatgcagtaaaagaccttcttcagcagctgctgcccaaattca

SEQ ID NO: 36453 - DNA, 116 bp, Homo sapiens
cttcctcttcatgttgttcattctgtggtttcacagatgtgtgatgcatgtgcccaccactgcagtgtcacacaggatctcactgccccggagtcctctgcgctgtccccgcccca

SEQ ID NO: 36454 - DNA, 183 bp, Homo sapiens
  misc_feature 53: s=g or c
ttgttttttgttattattatacttcaagttttagggtacatgtgcacaacgtsaggtttgttacatatgtatacatgtgccatgttggtgtgctgcacccattaactggtcatttagcatcaggtatatctcctaatgctatccctccccactcccccaaccccacaacagtccccggtgcta

SEQ ID NO: 36455 - DNA, 332 bp, Homo sapiens
  misc_feature 178: y=c or t
  misc_feature 179: s=g or c
  misc_feature 218: k=g or t
  misc_feature 219: y=c or t
  misc_feature 326: m=a or c
  misc_feature 329: v=a or c or g
tagaatctcaagaatctcagctccagctgggaggggaccctcagcggctcagcggctcagccgtggtggcatctaccctccctgtttaaagaaggaatctgagggaacttcatgtgcagataatcaaagggacaatgtctcttgttcattcctgtggtccaggcacctgaacgaaggystggcaaccttcattcctccatcccactttttaagaagckytctctatgctgagtgctgggaatatagacaagtcacagaacaagacacacaacccaggagggaaacagatgtacttctggactcacgggcctggggcaacccagcamagvtct

SEQ ID NO: 36456 - DNA, 239 bp, Homo sapiens
  misc_feature 129: b=c or g or t
  misc_feature 151: d=a or g or t
  misc_feature 156: r=a or g
  misc_feature 163: m=a or c
  misc_feature 169: r=a or g
  misc_feature 174: w=a or t
  misc_feature 203: r=a or g
  misc_feature 227: w=a or t
cattttttagtagagatgggggtttctccttgttggtcaggctggtctcgaactcccgacctcaggtgatccacctgcctcggcctcccaaagtgttgggattacaggcgtgagccaccgcgcctggcbttcagtttcttcctagggccgdtcttrtcacccmaaatarctgcwacccagaggggcggggttgacctaggctraatatccactttgtttttatggawggctcccttccc

SEQ ID NO: 36457 - DNA, 150 bp, Homo sapiens
taatagttataaaaaaataaaattgccttcttaaacattttcaattgtacggtctagtgatgttaagtatatttacattatattgcaatgggtgtctagatttattttatcttgtaaaatacaatacccaataaaaaataaactggccat

SEQ ID NO: 36458 - DNA, 291 bp, Homo sapiens
  misc_feature 5: w=a or t
  misc_feature 12: w=a or t
  misc_feature 99: w=a or t
  misc_feature 246: d=a or g or t
  misc_feature 247: m=a or c
  misc_feature 290: n=a, g, c or t
ttgtwttacttwatttataactgacacataataattgtacatatttatggggtacggtgtgatatttcaatacatgtattacactgtataatgtcaaawcagagtaattaagcacatccatcactttaaatacatattatttctttgtagtgatatcattcaaaatcctctcttctacctatgttgaaaatataccataaactattgtgagttatagtcattctattgtgaagtaagaacaccagdmatgtcttcttttccatccaactgtaactttatgcccaatgccna

SEQ ID NO: 36459 - DNA, 101 bp, Homo sapiens
  misc_feature 33: m=a or c
  misc_feature 34: m=a or c
cctgtgctcacctcttagcttgctaaacgtgammttcccaactccaccccaatgcccatgctaggaagggcactggaaggacctggaaaatggtgttgaga

SEQ ID NO: 36460 - DNA, 103 bp, Homo sapiens
  misc_feature 11: k=g or t
  misc_feature 12: r=a or g
  misc_feature 17: r=a or g
  misc_feature 21: k=g or t
  misc_feature 57: w=a or t
ctaacaacttkraacargtakcaattaaaggggtgatgataaggagcatttaaggtwatgttccaggttcagggtgttagattaagcctcctaaagtggcact

SEQ ID NO: 36461 - DNA, 60 bp, Homo sapiens
  misc_feature 16: k=g or t
  misc_feature 17: w=a or t
  misc_feature 20: k=g or t
  misc_feature 32: k=g or t
  misc_feature 40: m=a or c
  misc_feature 43: y=c or t
attgtgtgctggtgakwgtkagtacagggaakcagcggcmgcyatttcagggagcttgtc

SEQ ID NO: 36462 - DNA, 162 bp, Homo sapiens
  misc_feature 66: m=a or c
  misc_feature 150: m=a or c
cagccatttctccagggagtcttggttccttataatggagaatggtatttatttatttttatttgmtttgattattattactatttttgagacagagtctcgctcttgtcgcccaggctggattgcaatggcacaatctcagctcactgmaacctccacctc

SEQ ID NO: 36463 - DNA, 66 bp, Homo sapiens
  misc_feature 42: w=a or t
acattcctgtaatggcgtcgctcggggtcccgggaaattgcwccgtgggctttcagcggcggtttc

SEQ ID NO: 36464 - DNA, 90 bp, Homo sapiens
  misc_feature 15: s=g or c
  misc_feature 34: m=a or c
ttccacctctgcctsatctgttttggttgggagmtggaggccatgtgggaccaaacgttggcccaagtatccaggactatgcagggtatt

SEQ ID NO: 36465 - DNA, 263 bp, Homo sapiens
  misc_feature 47: m=a or c
  misc_feature 152: r=a or g
  misc_feature 229: w=a or t
  misc_feature 230: m=a or c
  misc_feature 235: w=a or t
caaggactaaaaatataactgctaaaaatcctgcaaaatctaatacmagtaaacctaatacaatcaaatccaacgcaagtaaacctaatacaagtaagcctaaatggaagtaaatctaaatacaaaccaaaaatctctaatatgcaaaagaracaaagcacattggctagtagcaaataaaaaaagtaaagtcaatacagcattgaggaatttaaggtaatcttttatwmctgawatacaatataatttaaacttaagtataa

SEQ ID NO: 36466 - DNA, 248 bp, Homo sapiens
  misc_feature 239: d=a or g or t
  misc_feature 240: m=a or c
aaataaatgttggcttaatttgcagaatagataaaacaattgatgtttttgtgtgttcaagaatgcattaaattcttttaatagtaaaaagtcaaattacgaccataatgagtattttaatcttgttcttgttcagtattttgtgtagatttttattgtaattgtcctgagttctacagtatgtgaacaatatcgtgtgaagtgtgtttttgcatttgtgcatttaaattatttatgtdmctagggct

SEQ ID NO: 36467 - DNA, 152 bp, Homo sapiens
caagcattcctatacactaataacagacaaacagagagccaaatcatgagtgaactcccattcacaattactacaaagagaataaaatacctaggaatccaacttgcaagggatgtgaaggacctcttcaaggagaactacaaaccacctgc

SEQ ID NO: 36468 - DNA, 63 bp, Homo sapiens
  misc_feature 16: s=g or c
  misc_feature 34: w=a or t
caggtttctcattaascttttacttaatggtttwaatagccaccgttcagtgcttatcaaaca

SEQ ID NO: 36469 - DNA, 113 bp, Homo sapiens
  misc_feature 68: w=a or t
  misc_feature 69: n=a, g, c or t
  misc_feature 81: m=a or c
tttacacagagaggtttttcattaggccaaggttatacagctagcagaggggctttgattcatgactwnttataaaagtgmtgtatgtagaaagcagaggggtgggaagcttc

SEQ ID NO: 36470 - DNA, 218 bp, Homo sapiens
  misc_feature 163: m=a or c
cccaatgatcaactattcgaatctccttctttcccatttccccattcctttaactccccacttcccttatccttctgctataccatccctaaccctgtaacctcatgatgctggattcgttgctattcacggtctaagagatgcagcaggagaaaaatgatamcaattatgtaaattgttgctactatgaaaaacagtttccagtctcactgtagcaa

SEQ ID NO: 36471 - DNA, 80 bp, Homo sapiens
  misc_feature 69: k=g or t
acactcatccctctccctactttccctgcaccccaggggacacttgctttcttgtctggctcctctttkattcctactcc

SEQ ID NO: 36472 - DNA, 133 bp, Homo sapiens
  misc_feature 36: s=g or c
  misc_feature 37: s=g or c
cctgaaatgactgctgtcaccatgcagtgattttassccccttccctggcctcaggaataagccaagaaattctagttgtgcagaactgagcttgttgccccttcttgtactgatggaaatagtgccatgtcc

SEQ ID NO: 36473 - DNA, 339 bp, Homo sapiens
  misc_feature 149: m=a or c
  misc_feature 151: k=g or t
  misc_feature 153: m=a or c
  misc_feature 159: k=g or t
  misc_feature 160: k=g or t
tttcattattttttaatggccaaatagtatcccattgtgtatatatgccacatatgtccattaatctgtttttgttttgttttgtttttaaaggcagggtctcactctgtcacccaggctggagtgcagtggtgcaattcatggctcamckgmagtgakkagccgggaccacaagcataccccaccacacctggctaattaaaaaagaattttttttgtagaaatggaggtctcactatgttgcccaaactggtctcaaattcctgggctcaagcagtcctcctgcctcggcctcccagagtgctaggattacagacctagcactgtgcctggccccaa

SEQ ID NO: 36474 - DNA, 149 bp, Homo sapiens
  misc_feature 27: k=g or t
  misc_feature 140: m=a or c
  misc_feature 147: y=c or t
tggattttaatatatagtttgtttttktgttttttttttcgagacggagtttcactattgttgcccaggctagagtgcagtggcatgatctcagctccctgcagcctctgcctcctgggttcaagcgatttccctacctmagcccgycg

SEQ ID NO: 36475 - DNA, 304 bp, Homo sapiens
  misc_feature 111: k=g or t
cataacttgtatgcgtataggtattttatctggattgaagtattaaacatctgtatacaaatcctaggtattttcacattgctttgaaactgacaaaatattacctgctakgtacaattgactcattaatttgttatacataggatacagcaacaaatctggctttatgcaatccaaaaactgataatcaccacataatttttcatctgaatatgttgcaataggttttaattttattgctttgaaaacaccgtattacagtactgtatttatgacgtaacttatattagcatgatgcggaagg

SEQ ID NO: 36476 - DNA, 83 bp, Homo sapiens
  misc_feature 77: r=a or g
gaactcaccctatcacacgttgacgaatgcaagagcctgttagagacactggaacccaagatggtgtcctggggaartgtcgc

SEQ ID NO: 36477 - DNA, 229 bp, Homo sapiens
  misc_feature 115: k=g or t
  misc_feature 154: b=c or g or t
cattctggttattgatggaagcaaattgcttcctatgttctctaaaccttatgtcccttccatactccatgagtaccacactgggagaaaacaaaagcaaaaagattgtgggaakaagtatagccattatctttgaggaaatgtgtaccaaggbacaatcattaaaaggagttggaggcatcatttggttgacactgttgtcattcttgttctgatcattttggaccga

SEQ ID NO: 36478 - DNA, 341 bp, Homo sapiens
  misc_feature 118: n=a, g, c or t
  misc_feature 219: d=a or g or t
  misc_feature 298: v=a or c or g
  misc_feature 299: n=a, g, c or t
  misc_feature 300: n=a, g, c or t
tcgaaatgggcaaatgagatgtcataccacacaaacctcaaggggaggagttcaggacaacttctcaccatgggactactgcatatagtctatacacaagggtatcttgctttgtganacagatgagctcttgcaaaactttattacaataattccatttacaccaatagagggtatcatataaaaccataatacacagatgattcccaaataacctcdtcagcttagacctctctcctggacctcacaaataaccaatgcttagtgggtaggtagctcctcctgaatagacatctcvnnttaggtttaaaaaacctaattctgtatctttctcccccgcc

SEQ ID NO: 36479 - DNA, 451 bp, Homo sapiens
  misc_feature 12: k=g or t
  misc_feature 13: k=g or t
  misc_feature 112: v=a or c or g
  misc_feature 450: y=c or t
  misc_feature 451: m=a or c
caggggtgggakkgagaattatttttcattgtatgccagcctttacattttgaatgttgtaccaagcattatctattccaaaacacatcatatttttaaaaatccttacaavaagacaaaaagcaaaatagaaaatattgtagcatttgttttcattgcaatttaccatacatgccatccaaagattgtctactttttggaacatttgaatacagtgatagacaactgtgatcctaaaattacagttaatttatattcctttgctggtactacccaatcttgcagtgccttaggatcgtcactgtggatgttgattttcattgtactcagaatgtgaacatgttaattaatagaagtattactatgataacagtttattatatgtatttttttagaaacatcaggttttttttggttaagaaatgactaaagttggatggtttatataaym

SEQ ID NO: 36480 - DNA, 211 bp, Homo sapiens
  misc_feature 102: w=a or t
  misc_feature 112: m=a or c
  misc_feature 116: r=a or g
  misc_feature 181: r=a or g
ttcaaaactcttgttaatatttatattttgttcttctctcttgaatcacgaatgttcttaatggcatctagaatggcaaatcttttccggaaagtttttaawttactttgcmctaratccttcagaggaatcaccagctatggcagctataaccttgcgaaatgtatttcttaagtaacargacttgaaagtcagtattactcttggatac

SEQ ID NO: 36481 - DNA, 275 bp, Homo sapiens
cttgactggatacagtggctcacacctgtaatttcagcactttggtaggtataggcaggagtatcacttgagcctaggagtttgagaccagcctgggtaaaatagtgaaaccttgtttctacaaaaaatttaaaagttagccaggaattgtggcatggccctgaggttccagctacttgggagggtgaggcaggagaattgcttgagcctaggtcaaggctatagtaacctgtgaccacgcgactgcactctatcctggccaacaaagcgagact

SEQ ID NO: 36482 - DNA, 234 bp, Homo sapiens
ctgcaactggtgttcaaaccgaactcaaacgatatacctctattttgaaatgttaagccacttcccatcttaataaatgggaaagccacagtcctaatgaagggcctataaggccttgttggagatacttcccagcttcccctcagaacctcttgcttttcttctcttgctcacacaattccagctacggtggctcctttgcagtacttcacacatgccacgcacacccccgtc

SEQ ID NO: 36483 - DNA, 187 bp, Homo sapiens
cagaattggaggctgaactccagggtgcctttgtatagttgtggatgataccaacagagtgggaaggggcagtggaccactgtgctggagttctcttgaaactgaccatgacctccctggtgacagaaaagaacagtcatcaataaaatctccttgaatggtatgcagtttacattaacagggtagt

SEQ ID NO: 36484 - DNA, 585 bp, Homo sapiens
  misc_feature 258: b=c or g or t
  misc_feature 419: k=g or t
  misc_feature 420: n=a, g, c or t
  misc_feature 421: v=a or c or g
  misc_feature 422: r=a or g
  misc_feature 548: w=a or t
tagcatagaaacctctgcttgtccattcctgattgatggttagctggcctctgcttgttgactgcattgtgttgagccttggccccttgaaatgtggtctgtggaccagcaccatcagcctctcctgggagcttgttagaaatgcagaatctcaggccccacctcagacttactgcataatcggcattttaacaagatccccaggagtttcatctgcatggtgggagtgggagagagtagaagttgaaggaggtaaabcactgtgtgttcaggcgagacactgagggcctgagctagggcagtgggagggagtaaaggagattgatgtggatattatcctgggactcagtagctaactggctcttttggcaacagaagctccaagatgacaagtttacagttgggtgatggaagaattknvratcaagttcataaaagtaggaagcaacagattgtgtagcggatatcactgattaattcagtgatccttgaggaccaggcactacttaggagttggcgacataatgaatgaaagtgtgtcctctgtwcttggtatttacaatttaacattgaaggactggtttt

SEQ ID NO: 36485 - DNA, 339 bp, Homo sapiens
gtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaaattccctcctagcacca

SEQ ID NO: 36486 - DNA, 400 bp, Homo sapiens
caggttctgaatgttctttataaatgtctgtatactggaatctagtcatgctgtataaaaaaagtttgtatacttggaaaagattgtaaaggttattagcgtagtgtatccacctcgagttttgttcattgaaggatctttttcattagtgtattccagttgtacatattaaaatctctcacatttattgtaataaattcttctaaatatcacaggactactagaaatgtattacattgtcccttaggtttgatttttaaagtaatgcccacataactttttattcatctaataagtcagaggttaggtatgcaaatatgatttatactttttaagatcatggcatcattgtaggggaatagaatttatatacatagaagttaaatactacaaggcagca

SEQ ID NO: 36487 - DNA, 314 bp, Homo sapiens
  misc_feature 204: w=a or t
  misc_feature 205: w=a or t
ttaagttcacaaaaagccattacaagaagtggaaatagcagcaattacacatggtgctcttcagggattagcctacttacattctcatactatgattcataggtaagtgctttggaaattatatattgataagtaaatggcttgtttgcatatacccaacttttagaatttattaactctaaagtttttattggttaaagccawwtaaaataatataagctcatatttttttagatttttcatgtcctaaaatgaacatagttgtatactttatctcactaggataatttttatctttgcctatatgtgctgcg

SEQ ID NO: 36488 - DNA, 373 bp, Homo sapiens
  misc_feature 149: w=a or t
  misc_feature 150: r=a or g
  misc_feature 173: r=a or g
  misc_feature 217: d=a or g or t
agagctgccgccgtggtgctgaggagccgagcgggcagggagcctctagctgctccagcatcccacttgctcactgccccctgatcccgtggacagcgcagtcagaggcaggagcaggagaggaggaagcagaggaaaaggagggaggwrgaaggcggcttgcaactcctcaratccagagccggactctgagctaatgagggagcagcagacacgdcctcccaacccttcccccaaggggaacccaaggctcactggagcagtcgcagttaatcctacgtggatcctgcctcctctcccaatcctgtgggtgggacataaatacccagccagcctcagggtgtgggccgagggcttgaagaagtagccgcca

SEQ ID NO: 36489 - DNA, 50 bp, Homo sapiens
  misc_feature 3: k=g or t
  misc_feature 5: d=a or g or t
  misc_feature 18: h=a or c or t
  misc_feature 26: w=a or t
  misc_feature 29: w=a or t
  misc_feature 44: d=a or g or t
tckcdaccggcgggatthgatggcgwgawgtctcacagaaagtdctccgc

SEQ ID NO: 36490 - DNA, 220 bp, Homo sapiens
  misc_feature 3: m=a or c
  misc_feature 4: k=g or t
  misc_feature 54: w=a or t
  misc_feature 142: y=c or t
  misc_feature 151: k=g or t
  misc_feature 164: w=a or t
  misc_feature 165: r=a or g
  misc_feature 166: r=a or g
  misc_feature 180: w=a or t
tgmkgggcatttgggttgattccatgtctttgctattgagaatagtactgccgwgaacatacatgtgcatgtatcttcataatagaatgatttatattcctttgggtagatacccagtaatgggattgctgggtcaaatggyatttctggkttccagggtcttwrrggaattggcacacwgtcttccacaatggctgaactaatttacattcccaccaac

SEQ ID NO: 36491 - DNA, 150 bp, Homo sapiens
caggaaatacagagaacgccacaaagatactcctcgagaagagcaactccaagacacataattgtcagattcaccaaagttgaaatgaaggaaaaaatgttaagggcagccagagaaaaaggtcgggttaccctcaaagggaagcccaat

SEQ ID NO: 36492 - DNA, 119 bp, Homo sapiens
cagatcctgctctgttcaatggggttgggaatggaaaataagtccttctggtctcctacctcatttccccatcagagattatatactcctccttaatcttaaggggcttgcagaagggc

SEQ ID NO: 36493 - DNA, 126 bp, Homo sapiens
accgtgtcataataacatatgtgttcctcagtgttgggttggaggctaaattcctgcaagccagtggttagtaataaacccaaataatagtgaagagagctctggacagagagttgaggtttaacc

SEQ ID NO: 36494 - DNA, 252 bp, Homo sapiens
  misc_feature 15: w=a or t
  misc_feature 130: r=a or g
  misc_feature 144: w=a or t
  misc_feature 145: r=a or g
  misc_feature 159: w=a or t
  misc_feature 160: h=a or c or t
  misc_feature 162: w=a or t
  misc_feature 169: d=a or g or t
  misc_feature 171: r=a or g
  misc_feature 186: b=c or g or t
  misc_feature 187: r=a or g
ctattaatgtactawaaaggtagattgctaagaaggtgtgtgctttttaacatattgtggtagactcttcaacttcctttctacccccttataatttaatttaaaccatacgaaaattggcttgtgaggrtatgtatgggggawragaatctaaccctwhcwatataadaracacacatcggctgbrcattatggcccacacctgtaattccagcactttgggagaccaaggtgggtggatcctttgagcct

SEQ ID NO: 36495 - DNA, 114 bp, Homo sapiens
ctcaagttcaaagttccacagatctctagggcagggtcaaaatgctgccagtctctttgctaaagcatagcaaggatcaggagaacagcatgggggaacgtccccatgatctaa

SEQ ID NO: 36496 - DNA, 211 bp, Homo sapiens
  misc_feature 51: y=c or t
  misc_feature 157: m=a or c
  misc_feature 209: m=a or c
ctacaaaaaaaaatttaaaaattagctgtgcaggaggctgagttgggaggyatcacttgagcttaggagttagaggttgtagaaagctatgatcataccactgcactccaggctggatgacagtgggccctgtctctaaaacacaaaaaaaaactamcaaaaaaagtgtttaatccataagatgaccacatttataggaggctcccggmat

SEQ ID NO: 36497 - DNA, 169 bp, Homo sapiens
ttacgttggtcagcagtagctggcactatctttttggccatctttcgggcaatgtaactactacagcaaaatgagatatgatccattaaacaacatattcgcaaatcaaaaagtgtttcagtaatataatgcttcagatttagaagcaaatcaaatgatagaactcctt

SEQ ID NO: 36498 - DNA, 101 bp, Homo sapiens
  misc_feature 60: s=g or c
acacaagtgcggaagaggaagagccaccgcctgttaaaatagcctggaaaactgcggcasaaggaaatccttaccagcttccattacgatgcacaaaggga

SEQ ID NO: 36499 - DNA, 110 bp, Homo sapiens
  misc_feature 12: r=a or g
  misc_feature 17: s=g or c
  misc_feature 41: m=a or c
  misc_feature 82: r=a or g
agacagcctcaragctsgtggggagacagcatgccactggmaaaattcgtagacatggaattcctggatcaaatggtatgaracaatttaaggtttcttccccccaacgt

SEQ ID NO: 36500 - DNA, 347 bp, Homo sapiens
  misc_feature 216: b=c or g or t
  misc_feature 321: m=a or c
  misc_feature 322: m=a or c
  misc_feature 323: n=a, g, c or t
  misc_feature 324: n=a, g, c or t
tacatgtaatgtataagcagtgcttggcacatgtgttgccattatagttaggatttttactatcagcttctgtagctactagggcactgcttaaacaaattaatgaacccaagttttacttaaaagacaatggaatctaaagccagaaaggaatgaaagccacatgattgtgggcctcctgtcctgccaagagtcagggctcagagtctcacgacbtgccttcaacagtagcggtccagtggttattgttcaccctggatagcatacacaggcccgggggtgggctgctggtgtttacgaagctcttcaaatgtttccccmmnntttttaatgtaagcagcgggata

SEQ ID NO: 36501 - DNA, 189 bp, Homo sapiens
tctagctagatccaagtctgctctgcacatatctcatccttcctggaccagtggccatttgaggttcattcttctcatggtgaagggtgggagcctaacggagcaagcccagccatgcaagcatgtttcagatcatgtcctctaatccctgtggcaagtctcatggccaaacgtaagatcaagggcgat

SEQ ID NO: 36502 - DNA, 308 bp, Homo sapiens
tatttattttttcatttgaatcaaggcctttttggtattcctgatagtaaaactatttggagaattgaaaatgaacttgtgttaaactcttcattctaggatcttttactattactaaagtcaaatgtaattacttcaaatgataattagaaatcatcttgaaagacttttgtatatggtagaatagatgatggttgtgtttttagtacttttgttgcaattatctatgtatggccagtgccagacagataattttttactatcctccctcaactattttttcttattttcttaactgattccatgcc

SEQ ID NO: 36503 - DNA, 132 bp, Homo sapiens
  misc_feature 103: s=g or c
  misc_feature 121: v=a or c or g
tttagtagagatggggtttcaccgtgttggccaggatggtctcaatctgaccttgtgatctgcccacctcggcctcccaaagtgctaggattactggcgtgasaaccactcctagccttavtgcatattctt

SEQ ID NO: 36504 - DNA, 258 bp, Homo sapiens
ttgatattttgttaacagcttaaagaaatcctgatatatagaccttaagactccaaaatgagagaaagcaatgtcatgcaatagtaatagccatgtgttcatgtgcaaacactaataggcccaatcaacatttagattttgacttgatttcaaaatattagtgtataaattaacagtgtaaaattatgaaattatgagcaatatcaagcaacaggagaatctatattttcttcaaagcataattgtagcccagggcta

SEQ ID NO: 36505 - DNA, 120 bp, Homo sapiens
tttcatttgtaatgaagaaagtattacctttaatcttctagttgggaacatactttggaattcactctatctaaccataatgttttactgtatgtactttgtgtgtgaaagtgtgtgtgt

SEQ ID NO: 36506 - DNA, 123 bp, Homo sapiens
  misc_feature 121: s=g or c
tctgatctctgacctgcgttcttagctgggacgtcgagttctcccaggataattatcgaccagctgccatgtaagacgtgcctttcagcttccaccatgattgtgaggtctctccagccasat

SEQ ID NO: 36507 - DNA, 97 bp, Homo sapiens
  misc_feature 37: w=a or t
  misc_feature 78: y=c or t
atacaagataacagaatcacaacatatcaaaatctawgggatacagcagaagcagtattcaaagggaagtttatggcyataattgcctacatcaaga

SEQ ID NO: 36508 - DNA, 217 bp, Homo sapiens
  misc_feature 28: k=g or t
  misc_feature 64: w=a or t
  misc_feature 69: k=g or t
  misc_feature 97: w=a or t
  misc_feature 105: s=g or c
  misc_feature 121: w=a or t
  misc_feature 123: w=a or t
  misc_feature 131: w=a or t
  misc_feature 140: w=a or t
  misc_feature 141: w=a or t
  misc_feature 155: w=a or t
  misc_feature 157: w=a or t
  misc_feature 164: m=a or c
ctgctgcatctgtctatgccaaactaakcaataccgattgcaccaccaaactccattgcaaatwcagckgtgaggagattccctttcagacaacttwgctgaaasagcttggaaattcggwgwcgaagggwctgccacgwwttcatgcttgcatwtwgggctcmaaattggcactgggaaggggttactgagagcacaaggctgataccaggcccat

SEQ ID NO: 36509 - DNA, 140 bp, Homo sapiens
  misc_feature 3: w=a or t
  misc_feature 4: w=a or t
gawwaaatgcactgtaaatatgctttagttttaattcagttgggatgcactacctagcgaaaattgagaaactatatacttctcagagaaatatctgacatctattgtcattccattgctattttttttccccagagaca

SEQ ID NO: 36510 - DNA, 145 bp, Homo sapiens
agttcagagccaccttaaaagcaggaggcagttgtaaagtcgctggccagctagtggagtggagactgcagagggagataaagagagagggcaaagaggcagcaagagatttgtcctggggatccagaaacccatgataccccac

SEQ ID NO: 36511 - DNA, 385 bp, Homo sapiens
  misc_feature 2: r=a or g
  misc_feature 22: y=c or t
  misc_feature 141: k=g or t
  misc_feature 142: r=a or g
  misc_feature 148: s=g or c
  misc_feature 292: w=a or t
  misc_feature 294: d=a or g or t
  misc_feature 295: n=a, g, c or t
  misc_feature 296: n=a, g, c or t
traaaataaaactattggtgtygtaggtttgttttcaattcaagctaaaagtgagatgacttggtttccactaattttttttggcgaaagaaaaagggccttaagttctcatgttctataattttctaatagtaataatakrtttaasaatttaaatggaatagcataacaggactatttccaaactatcagagtaaattgagctgaatttttcagactgaaatcaaaattggtgtatttattgaaaaacaaacacaatttctcaaagaaatataggtatcgctaagaaatwtdnngagatgttttttaatttattatactttaagttctgggatacatgtgcaaaacatgcaggtttattacatatgtatacacatgccatggt

SEQ ID NO: 36512 - DNA, 122 bp, Homo sapiens
  misc_feature 102: y=c or t
cattcccataaaacacaaattccagaaggaaagatggtgtcagcgacatctcttacgctgttccactgtttgccctcaggtgactcggtcactggttcctgytggatgcttctagatctgca

SEQ ID NO: 36513 - DNA, 216 bp, Homo sapiens
  misc_feature 172: r=a or g
  misc_feature 173: n=a, g, c or t
  misc_feature 174: b=c or g or t
  misc_feature 186: w=a or t
  misc_feature 187: r=a or g
aggagctctacctccaagtgggagccacacgcctgcagggttcagagcagacccttccccaggccccgcctctctatttccaggggtgataaagccatctctgggctggcttaagagactgagggctgaactcagagccctgccacccccaacagccttgcagcctccctgrnbactttctgggcwrctggggagtcttaactattctctcccccc

SEQ ID NO: 36514 - DNA, 211 bp, Homo sapiens
  misc_feature 6: w=a or t
  misc_feature 111: m=a or c
ccaagwcaaagaaaggaggggaaaaaaagataaaaagcaagccagggttccctgccctattgaaactcaaacccagactgccttgggttttatctttcccttacccctggmacctccagagaactgggacctgaaatagtccctccgttctcccctttgaccatgtaataaatgaaccagaagcactgagattaacctatcaacgccctga

SEQ ID NO: 36515 - DNA, 242 bp, Homo sapiens
  misc_feature 58: m=a or c
  misc_feature 72: s=g or c
  misc_feature 73: m=a or c
  misc_feature 74: s=g or c
  misc_feature 75: y=c or t
ccttgtattgttaaaacgagatcaggaaaaagcatggcaaataggaaatttgaatagmaatctgatgtatasmsycttaacagatgaatattgaaataggatattttaggtagttgcaaaagcattttatttagtcattaatttattcatccacatacatccatcaatctcatttatgcattaattaattcattcattcaaaagatgcattttaaaaagtagtggatataatagatagcccc

SEQ ID NO: 36516 - DNA, 69 bp, Homo sapiens
acttcggcagaaacactggggcattctcattgccagcctcggggggtggctggcacaaagagcccaaga

SEQ ID NO: 36517 - DNA, 119 bp, Homo sapiens
  misc_feature 18: h=a or c or t
  misc_feature 19: n=a, g, c or t
  misc_feature 20: n=a, g, c or t
taaaatgctaggattachnncatgagccactgtgtctggccagaatagagatatcttataggcagttgaatatgaatgtctggggcttaggacagatctgggtgtgaagatagaggtta

SEQ ID NO: 36518 - DNA, 253 bp, Homo sapiens
  misc_feature 39: m=a or c
  misc_feature 150: w=a or t
  misc_feature 151: y=c or t
  misc_feature 225: k=g or t
gatgggatcctgacagcagagtaactgcatcaggtgggmactgactttcctctcagctgcatccttcagaggaaggtccttcaaagtgaaatcgtcaagaggagtggtggtattgctgcccactcgatgggaaatgtggctcagaggggwyccacacacctgtaaatagagtaactactagataatgacagcaagcaaagaaaaaattaaatattcctgttgtakagataccagccaaatcttaccaagaccg

SEQ ID NO: 36519 - DNA, 91 bp, Homo sapiens
taaggacaaggaaacctctgagtctacctaatatgttaaggacaaggaaacctctggacagtggtatattggggaattttttttttttttt

SEQ ID NO: 36520 - DNA, 290 bp, Homo sapiens
  misc_feature 265: r=a or g
  misc_feature 266: n=a, g, c or t
  misc_feature 267: n=a, g, c or t
attcaagtggaggaatgtgctggtgagagaaagacaagtttggtttgggacaaatgcagtgtgagggccccagcctcttggctggccagtgaacacttccaagaaccttcatacttaatacctctatcactcctccactcaacaggatatgccaggctgcaggctacagtgccgagaaggagaagacggaggcgatggtgatgtcacccaaggaattaagtaagcaggggagctgataacatcgtccagccaggctcactgtggrnngggtgactcactgaagacggctc

SEQ ID NO: 36521 - DNA, 148 bp, Homo sapiens
  misc_feature 35: w=a or t
  misc_feature 61: w=a or t
  misc_feature 64: w=a or t
tacatatcacctctctaatcaaggtttattcctgwtgtattgaggagccctgaagtcaggwtgwggaaatggtgatcaagggatcatctttgaaatgtgcttcccccaaccaaactgtatctacattttcagtctcccaaccagcccc

SEQ ID NO: 36522 - DNA, 238 bp, Homo sapiens
  misc_feature 12: r=a or g
  misc_feature 176: n=a, g, c or t
ctgtttaagagrgaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaatnttacaattctgagtgatcttagaaatcatttctgtttttacaaacaaggaaactgaggtcct

SEQ ID NO: 36523 - DNA, 90 bp, Homo sapiens
aagcaaacggcagggcgcgtaataacttttctttctttcccttttgcgcgcgttcgatatgcttgtctctactaccaactcctcagcccc

SEQ ID NO: 36524 - DNA, 94 bp, Homo sapiens
  misc_feature 62: r=a or g
  misc_feature 80: r=a or g
agttcctgcgcgtgcgcgcttggcctccctagtgcgggctggcagtgcgggcagagcccggrctgagaggggcggccctrgaggagacggaggc

SEQ ID NO: 36525 - DNA, 279 bp, Homo sapiens
  misc_feature 114: d=a or g or t
  misc_feature 120: w=a or t
  misc_feature 126: y=c or t
  misc_feature 128: m=a or c
  misc_feature 131: k=g or t
  misc_feature 138: d=a or g or t
  misc_feature 140: m=a or c
  misc_feature 141: m=a or c
  misc_feature 172: k=g or t
  misc_feature 250: r=a or g
tttcactgtcacaagaaaacaaagtgccaccgaagaaaagtaatgactgagagcattgatgtacttattttgtcagtttgtaacaggaaagtgggggggagtctaagtcttcadagtctwattgtycmagktgggttdgmmctagatgtagaacacttggaggcttactttkcatggtaatgtccatttcctatttataacccctctgggaacgtttgtctaaaggaaatgtttctgttcagtgtaacarttacagttgcacctggattgcccagtcct

SEQ ID NO: 36526 - DNA, 106 bp, Homo sapiens
gcggaagtcagcggcgtccggtcccagcctcctctgggagcgggcagttggcgaccctgcactgacccgcgtccctccgtctcgagcccgcgcgccctcagagggt

SEQ ID NO: 36527 - DNA, 75 bp, Homo sapiens
tttgaaagttaggattgagtcccatcagaagattatctgattttatgacagtaattctccaggatttgggaaaga

SEQ ID NO: 36528 - DNA, 65 bp, Homo sapiens
gcattcctcgcgccgtcttcctggagtcccagctctccttcatcccgccccaacgctgacgctca

SEQ ID NO: 36529 - DNA, 102 bp, Homo sapiens
  misc_feature 15: w=a or t
  misc_feature 91: k=g or t
ggtctagaggaatawttaaacattttagaactattaacaggtaaagtactgaaatgggtacaacttaaggaaaacaagaatgttgtcttckaactctgacat

SEQ ID NO: 36530 - DNA, 107 bp, Homo sapiens
  misc_feature 53: r=a or g
  misc_feature 56: k=g or t
  misc_feature 77: d=a or g or t
  misc_feature 79: r=a or g
tctaaaaacagaaactgctcctgggggagataactcggaggttaatctctgcrggkgcccggccacagcctcgcgtdcrtttccagagaagggctctgaggttgcct

SEQ ID NO: 36531 - DNA, 255 bp, Homo sapiens
  misc_feature 35: y=c or t
  misc_feature 60: w=a or t
  misc_feature 132: y=c or t
  misc_feature 148: r=a or g
  misc_feature 152: r=a or g
  misc_feature 161: h=a or c or t
  misc_feature 183: m=a or c
  misc_feature 204: w=a or t
agttccaggcggcatggaggggtgagtctttgggyccgatggtgcaaggggggattcagwgcagctcagtggcctcaggccccggagctccacccatgtccccttggtgctgccgcttcttgtacttctgcygctggcccccggctargcgrggccgccghccagcgctgcccacaggcctgmatctgtgacaactccaggcgwcacgttgcctgccggtaccagaacctcactgaggtgccagacgccatccct

SEQ ID NO: 36532 - DNA, 114 bp, Homo sapiens
taaagtctttatacttaaaataaaaattttagttatagaataatgtaagcatactatagaaaatttaaacagcaacaaaaccgttttaaatattcaagctgcaatcccacctct

SEQ ID NO: 36533 - DNA, 287 bp, Homo sapiens
  misc_feature 126: r=a or g
  misc_feature 139: w=a or t
  misc_feature 149: k=g or t
gaaatatatataacagaaaaaatgctacaaaatcatatgggccgggcaaggtggctcacgcctgtaatcccggcactttgggaggtggaggcggatggatcgcttggggtcgggagttcgggaccrgcctggccaatawggtgaaatckcatctctactaagggtacagaaattggctgggcatggtggtgtgtgcctgtagtcccagctactcagggatgaggcacaagaatcacttgaaactggggtgcaggttgcagtgagttacctcgccactgcactccagc

SEQ ID NO: 36534 - DNA, 334 bp, Homo sapiens
  misc_feature 128: w=a or t
  misc_feature 131: s=g or c
  misc_feature 139: r=a or g
  misc_feature 149: m=a or c
  misc_feature 152: r=a or g
  misc_feature 153: k=g or t
  misc_feature 160: v=a or c or g
  misc_feature 183: k=g or t
  misc_feature 206: w=a or t
  misc_feature 225: d=a or g or t
  misc_feature 234: k=g or t
  misc_feature 258: b=c or g or t
  misc_feature 307: n=a, g, c or t
gtggttgtgtgcacacacggtagatggggattggtcatctcatcttactcatctctctcccgacggtgcctggcacgatgcctggcacatagaaactggtcagtggtggtttctgtggtgtgaatggwggsttgttccracagacttgmcarkagtccavcttttaaactgacagactctatktagaattgcagtaaactcatttwttttctctatctgggtgadtgaaatcgkctgcttttggtgtaaataacatgbaccaaattttaagtgttgggcctcaccccttcaccagtttcagttttcncagccccctgccattcctgcccccccc

SEQ ID NO: 36535 - DNA, 70 bp, Homo sapiens
  misc_feature 57: r=a or g
tagtattccatggtgtatatgtgccacattttcttaatccagtctatcattgttggrcatttgggttggt

SEQ ID NO: 36536 - DNA, 301 bp, Homo sapiens
  misc_feature 113: w=a or t
  misc_feature 121: w=a or t
  misc_feature 125: y=c or t
  misc_feature 126: w=a or t
  misc_feature 131: w=a or t
  misc_feature 132: r=a or g
  misc_feature 141: m=a or c
  misc_feature 300: r=a or g
caaacaaaatagccgcgtacccaaaacaacctaagagaccagttaaataaatcctcgcataggcatataatagaatactgcataatggagaaaatgtttgtcaagagtatatwcattgatwcaaywgattwrggaaaagamaaagtaagctgcagaacagtactcaaaatgaccacgttactctgaggatacgacgtcatcagagccgtaaactgctctagggaccaaggcgagccacttgcagggaagctgaaagagtgtgcgcagacaggagtagaacagagccaatgagaggaggarc

SEQ ID NO: 36537 - DNA, 117 bp, Homo sapiens
  misc_feature 30: b=c or g or t
  misc_feature 31: w=a or t
  misc_feature 34: w=a or t
  misc_feature 36: w=a or t
  misc_feature 44: w=a or t
  misc_feature 55: w=a or t
  misc_feature 109: m=a or c
ttgtaaaattcattttttatttattttatbwttwtwctgttttwcaatatatttwaaaagacatattttcctgatttttaagtcatcgttaggatggaaaatttggaamatatagta

SEQ ID NO: 36538 - DNA, 100 bp, Homo sapiens
  misc_feature 62: r=a or g
  misc_feature 72: m=a or c
aagggaaagacaaaggaggaagtgcggacggccgtcaagtgctacccgttgcagccgcaggrgccacgcggmcaattgtacagaatttaaaccgtctctc

SEQ ID NO: 36539 - DNA, 92 bp, Homo sapiens
  misc_feature 14: s=g or c
  misc_feature 15: m=a or c
agtctgcggctctsmtggatgcacgtcagcaaggaaggggaggaacgcgaggggagactgaagttcacgttccgctcttagtgcgcgtgcac

SEQ ID NO: 36540 - DNA, 186 bp, Homo sapiens
  misc_feature 133: m=a or c
  misc_feature 138: r=a or g
acactgcctttatgagctgtaacactcaccgcgaaaggtctgcagcttcactcctgaagccagcgagcccacgagcccacagggaggaatgaacaactccagatgcaccgccttaagagctgtaaacactcamggcgraagggtctgcagcttcactcctgagccagcgagaccaggaacccagcc

SEQ ID NO: 36541 - DNA, 369 bp, Homo sapiens
  misc_feature 118: m=a or c
  misc_feature 119: w=a or t
  misc_feature 347: b=c or g or t
  misc_feature 348: k=g or t
  misc_feature 351: y=c or t
cactgtgcattaagccttcctgggagcaaagaattttctgtgattagcatcaagctctgcctctgtgagggttcttgattcaagccagagatccagcaggtggaccttcctccgtggmwccagctctcccccttgggttccaaacattatctcttctccctttttctttaactgtcattttcaacttttggttgattccaccttctggcctctttgctatgccctcagattcattcttcctttttcataagaaatggcccatgtttgcagctgaataattttctcagcttgcttttttccccgtagaaagcttgtgactcaaatgcctcttttcactttgaacttabktayccctttattcaacccggt

SEQ ID NO: 36542 - DNA, 389 bp, Homo sapiens
  misc_feature 149: n=a, g, c or t
  misc_feature 150: k=g or t
  misc_feature 157: w=a or t
  misc_feature 297: w=a or t
  misc_feature 323: w=a or t
  misc_feature 340: m=a or c
  misc_feature 360: w=a or t
  misc_feature 363: w=a or t
tttaaattgcatttttgttctaacgttttgcaatttatattctttttaaaatatttcccataattcatcatgctagcttctgtgttcttggaatagtttttgaaaaatgcagagattcgaacatgagtccttaatatactaaacagtgnkagaatgwtgatatctcatttctaaagtaagcatggttcacaccactttggcaatacactgcagtactttttaaaaaatattctctagtgataaaagtaaagacagggtactggccaagatcctaattctgacttctgactgtgtgawcttcgatgaaatttatatttcccttwaatcattactattctamttgttaagtaaggctaagtwaawatttgtcttcgcttaaattctgattt

SEQ ID NO: 36543 - DNA, 66 bp, Homo sapiens
  misc_feature 15: s=g or c
  misc_feature 16: k=g or t
ctcatcaagtgctgskctcctcttcctggcccaccccactgggcagtcactaccaatggatcaaat

SEQ ID NO: 36544 - DNA, 109 bp, Homo sapiens
  misc_feature 90: m=a or c
  misc_feature 91: y=c or t
tacagttagaaagaaggaccaagttctggtgctctgtagcacagcaaggtgactacagttaatatatttcaaaatagccaaaagagaggmyttaaaatgttcccatcac

SEQ ID NO: 36545 - DNA, 109 bp, Homo sapiens
  misc_feature 15: k=g or t
  misc_feature 16: k=g or t
actgctggaatttgkktcctgcctatgaaataaaattatttttcagaattaaatttgaaaacttgcactacagaactatgggtggagcttttccttttacaacagtttt

SEQ ID NO: 36546 - DNA, 118 bp, Homo sapiens
  misc_feature 15: w=a or t
  misc_feature 16: k=g or t
caaaatatttgagawkatggatcacaaggccaggttacagagaatgcaggagctccaggaagcacagaatgcaaggatcgaaattgcccagaagcatcctgatatctatgcagttccg

SEQ ID NO: 36547 - DNA, 51 bp, Homo sapiens
  misc_feature 16: k=g or t
cttgatcctgaactgkgttaggtgccgctgttgctgctcgtgttgaatcta

SEQ ID NO: 36548 - DNA, 229 bp, Homo sapiens
  misc_feature 16: d=a or g or t
  misc_feature 17: w=a or t
  misc_feature 125: r=a or g
  misc_feature 131: n=a, g, c or t
  misc_feature 132: w=a or t
  misc_feature 134: y=c or t
  misc_feature 141: k=g or t
  misc_feature 144: w=a or t
ttttttacgagtgggdwtactttcggttgcaattgatggaaaattcttgtctaactgttataggcaggaaagtgtagtgggttccaggaatgtaaacattaccatcttctcaactatcaactaarttcttnwcygtatttkgcwtcacttagtggttctcatttccagtccacctgaaaaagcttgcccctttgtctctcacccagagattaactacagagacgcgacg

SEQ ID NO: 36549 - DNA, 134 bp, Homo sapiens
  misc_feature 133: d=a or g or t
  misc_feature 134: r=a or g
acagagctgcagctcttcagggaagaaatcaaaacaagatcacaagccatattagtgcatctgagaccttttgcaatgaactgggatgtaactgccttaaatactacaattgctgactacagggaaaccgtgdr

SEQ ID NO: 36550 - DNA, 201 bp, Homo sapiens
  misc_feature 17: y=c or t
tgcattaagagtctttyttaaatttttttatttttattttattattattatactttaagttttagggtacatgtgcacaatgtgcaggtttgttacatatgtatacatgtgccatgttggtgtgctgcacccattaactcgtcatttagcattaggtatatctcctaatgctatacctcccccctctccccaccccacaac

SEQ ID NO: 36551 - DNA, 232 bp, Homo sapiens
  misc_feature 151: h=a or c or t
  misc_feature 152: m=a or c
gtttaagttccgcgcgcaggccaggctgcaacctgacggccagatccctcgctgtcctagtcgctgctccttggagtcatgttcccagccgccccttctccgcggaccccgggtaccgggtcccgaagggcccgctggccggactcgggchmggctccacgccccggacggctagcaggaagggtctgcccctggggtctgcagtcagctccccagtgctcttctcgccggt

SEQ ID NO: 36552 - DNA, 117 bp, Homo sapiens
  misc_feature 112: m=a or c
gaggaggaggaggtggcggcctgggtctgacgcggccctgttcgagggggcctctcttgtttatttatttattttccgtgggtgcctccgagtgtgcgcgcgctctcgctamccggc

SEQ ID NO: 36553 - DNA, 170 bp, Homo sapiens
  misc_feature 122: r=a or g
atctctgcaacgctgtgatcaggatgcggtgggagctccgtcttgggtgatcctcgtgagggcatttttcagcgagctttgaaattcttcaatttttttttagttactccctggtgctaggraatctaccttttaaggaactgtatgtaattactgtatttgtcgggaga

SEQ ID NO: 36554 - DNA, 50 bp, Homo sapiens
tcagttaatttgtttggaatgtctatgttgaaactttctttttttttttt

SEQ ID NO: 36555 - DNA, 353 bp, Homo sapiens
aagttcttgctgctaaaagtgtggtttgtggaccagcagcattggcagcagtaagcaagggttggcatgctttttctgtacaggaccacatagtaaatattttcaactttgtagactagagaatctctgttggagttattcaactcttcaactctaccattgtaacacaaaagcagccttagataagatcagcttccagcatgacagcttaaggaacccattcctctgtaaaactggtgaaaattcttttttgttttgtttcgttttgagacagagtctcgctctgtcgccgaggctggcgtgcagtggtgtgatcatggcttactgcaaccctgaccaacctccctggcccc

SEQ ID NO: 36556 - DNA, 151 bp, Homo sapiens
  misc_feature 114: w=a or t
ttggatatggctactcgtccagcagggtaagaggtcaaatttgaaatattatgtatatattgattttttaaagtatgttatagtgcaggttggtgactctcagcctataaaatwtatatcatgttaaaattactacttttctgcgataact

SEQ ID NO: 36557 - DNA, 249 bp, Homo sapiens
  misc_feature 91: r=a or g
  misc_feature 104: w=a or t
  misc_feature 106: w=a or t
  misc_feature 111: w=a or t
  misc_feature 117: r=a or g
  misc_feature 123: m=a or c
  misc_feature 124: r=a or g
tatatgtactagaattgagcaaataactaaatttattatgtataatgacacactcagagaaaaggttttaaaaacaaggggaaaacatgartaagttttgtttwgwtgaawttgggraattamraaaatatcagaagaaacttaagcttatatatagaaacagatagacgagaaataaatgtagatgtgtgtattcatgtgctggtatataaacatagatttcttaactttccacctgagagggccaaa

SEQ ID NO: 36558 - DNA, 76 bp, Homo sapiens
  misc_feature 16: s=g or c
  misc_feature 18: y=c or t
  misc_feature 22: r=a or g
  misc_feature 32: w=a or t
  misc_feature 45: s=g or c
  misc_feature 50: s=g or c
gaatacacttagattsayaggraagaactcgwaatggagtttgastaaasaaaatgactgatgtactaaacccagt

SEQ ID NO: 36559 - DNA, 236 bp, Homo sapiens
tttaaattatacatttgtccttttttttgagactgagtttaattcttgttgcccaggctggagtgcaatgatgtgatatctcggctcactgcaacctccccctcccaggttcaggtgattctcctgcctcagctgtggggaaaagaaagagagatcagactgttactgtgtctgtgtagaaagaagtagatataagagactccattttgttcatcttgtgagtcgatgacgcacga

SEQ ID NO: 36560 - DNA, 291 bp, Homo sapiens
aattaatccatttttgcattattattatgcattttttccaaataagttttaaaaacttctttatgtataacctaggccctttacctctttagcttttttgtctttatgctttttcttactaatttgtgtgaactcagtttccttttaagtacacatttctgatggattaatgtttatttttctttttaaagcaatatttgactcattaaaggcaactactttacagaaatgtagatctctctccctccctctgccccgaaacagaaaaatacactatgaacaccactaacg

SEQ ID NO: 36561 - DNA, 341 bp, Homo sapiens
tagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaat

SEQ ID NO: 36562 - DNA, 118 bp, Homo sapiens
cactaggattatagggatgcatcaccgcgaccagcctcgtgtattatttaattagtagtcattcaacctatttttttctagatagtacattttgattagtacagtttatgattttttt

SEQ ID NO: 36563 - DNA, 318 bp, Homo sapiens
  misc_feature 140: s=g or c
cagaaatatggttatacacatagagtaacaacggggctgttgaacgtggtaatcttagtgaatctggttaatgctttaacaaacagacaataatcacaatcagcacatcgattgtttgaatggaactaggcacggaagtstgcttaaaatagtgtgttgattttcacataaagtaggccaaattctctatgtttacagtattaatttgcttagccagccctttatttcattgacagtacggagataaacttcagcccagctgtgactgaattatcgaatcaagaaacaagtatttgttgtctactgttagcgtgcctc

SEQ ID NO: 36564 - DNA, 234 bp, Homo sapiens
  misc_feature 15: s=g or c
  misc_feature 16: r=a or g
  misc_feature 128: m=a or c
  misc_feature 145: v=a or c or g
  misc_feature 154: r=a or g
  misc_feature 165: m=a or c
cagtattgaagaaasrttacacacccatgtttactgcagcactgttcacaatagatatgggatcaacctagatgcctaaatacatgaagaggtaaaatgtgatgtatatgtatatacacacacacacmcaatggaataactattvagccaccgraaagaatgaamatcctgttttcttgcaacaacatggatggaactggaagacattatgttaagtgaaataaaccaggagtc

SEQ ID NO: 36565 - DNA, 254 bp, Homo sapiens
  misc_feature 181: k=g or t
caaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacagktggcagatatgctgttggagctctgtgtcaccgagttggaggatgtggccacagactcgcagagcggcccgcc

SEQ ID NO: 36566 - DNA, 175 bp, Homo sapiens
actgactaaaataacccaatggatttgagagttaccgcaaaagaagcaaacagacaaactaaagaggtataactcctacttgaagagtgtgagagaatatttactactcggatgtttgagacataccaaaaaaatgctttttgatcctttatcaagaagacgtaatgaccaagat

SEQ ID NO: 36567 - DNA, 102 bp, Homo sapiens
tacaattagttaaaaaaaaatacgcatgctaaaaagaggtttatattcttatttttctcctaaattgcaggtatatactttaaaaatcttaaaaaaaaaaaa

SEQ ID NO: 36568 - DNA, 163 bp, Homo sapiens
agctttgtgactaaatgtgtggggagaagcaagctgtagtggacatcagccggatgtcctgcagttcagttctgacaccatctacctggagatggcatcagattccacaggttgtgagcaagactgtcccactctgccccactagccacaagaccaggccttt

SEQ ID NO: 36569 - DNA, 274 bp, Homo sapiens
  misc_feature 27: k=g or t
  misc_feature 28: w=a or t
  misc_feature 72: k=g or t
  misc_feature 122: s=g or c
  misc_feature 125: k=g or t
  misc_feature 129: m=a or c
  misc_feature 189: d=a or g or t
  misc_feature 212: k=g or t
  misc_feature 213: d=a or g or t
aacgcaagcaggaggcgggggagtcgkwggaggtggcggcgctggagctcctcccggggaccagcgacccgkggagcgagcacgtcgctccgcaccgctcttcctccagccgctgagccgtsccktctmgccatgtcccagagcaggcaccgcgccgaggccccgccgctggagcgcgaggacagtggdaccttcagtttggggaagatgakdacagctaagccagggaaaacaccgattcaggtattacacgaatacggcatgaagaccaagt

SEQ ID NO: 36570 - DNA, 275 bp, Homo sapiens
cgtaaactgacaagcaaggatattagtggaataactcttttttgtcatctcggtgtcatgaggggaacagggagctcttcggtcccattcgcaaattgaattttgggagtaaggaaaactaggtgtgcatgtgcctgtccaattagcaggtagccacatgtaggtagaggatccacagaggaagaagagagcttgtgccaggcaaaactggaaatgcaaagtaaaaagatgagaaggaatgctgaaaggggtgtcttgtacccagactcctaggg

SEQ ID NO: 36571 - DNA, 210 bp, Homo sapiens
  misc_feature 93: v=a or c or g
  misc_feature 153: w=a or t
  misc_feature 157: w=a or t
cagtacctaggggcaactatgtcagaattgattttaccagagccttaacaggggttcccagtattttgctgttataaacagagttgcattatvaacacacaaatattttgtggttcttctctcatacttcttactgccagtcatgagctgtcwctgwcagtgatcactttgattacctctctcaacatgtcattgcctttatcccaccct

SEQ ID NO: 36572 - DNA, 141 bp, Homo sapiens
  misc_feature 16: d=a or g or t
  misc_feature 126: v=a or c or g
gtggcgcgggtggcgdctgctgtgctggctgtggggacggaggcggtgaagtgccatcttcggctaggtcgtcacaggctccggctcatggcatcaagtggcatccatcataagatcgttaactgvagacaatatgcaaaa

SEQ ID NO: 36573 - DNA, 431 bp, Homo sapiens
  misc_feature 125: w=a or t
  misc_feature 130: w=a or t
  misc_feature 132: m=a or c
  misc_feature 133: m=a or c
  misc_feature 295: w=a or t
  misc_feature 296: w=a or t
  misc_feature 297: d=a or g or t
  misc_feature 298: n=a, g, c or t
  misc_feature 320: m=a or c
  misc_feature 331: r=a or g
  misc_feature 339: w=a or t
  misc_feature 340: k=g or t
  misc_feature 351: w=a or t
  misc_feature 358: m=a or c
  misc_feature 359: h=a or c or t
  misc_feature 360: d=a or g or t
  misc_feature 394: m=a or c
cttgtgctcatttgctaattactgagacagggagccagtacttgtttattcctttgaaaagtttcttaggacacagtgcttcattgaaaaaaagagggcatgaagcgtttataccggcaggtgcwtcatwgmmaaaaaagagggcatgaagcatttataccggcagacctgtttgctgctttttagctgtgttaaaacttggtctacaaaatattctatataacatgaggaaggaaatgacattcccctttttcatttaagaaggaaatattgggcattaattctcagtattctwwdngaagtgaaaactttaaaatgamatcacaatagragcttttwkttgttttttgwctttctmhdttcagcaatttctgtaccaagcgaggcttggggmgtgacctcgtcctccctgcatcgtcctggctggtaca

SEQ ID NO: 36574 - DNA, 56 bp, Homo sapiens
ccaggaatttgaaatcagtcaaatgacttttatctgggaaaaaaaaaaaaaaaaaa

SEQ ID NO: 36575 - DNA, 309 bp, Homo sapiens
  misc_feature 114: w=a or t
  misc_feature 120: w=a or t
tgtcagtttatccatcttatccttctcagcaggtacctatatgataatatatagctgtgaaactcatctaaatatttttgttccaataaaatattatatactattggggaaaawtcagtwtttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggtc

SEQ ID NO: 36576 - DNA, 254 bp, Homo sapiens
  misc_feature 13: s=g or c
  misc_feature 133: s=g or c
gtcttcgcgtgasaagttcagaggcgtggagggcggtgtgttcccgggaaggttgatgggtagaggttaggggcaagggcagggggttggaattgcattgatcccagcgtcttcatcaggaggatgggcggasacccaccgcagagggttattgagaaagttaatgagatcattaagctaaatgcgtagcatattctaagcctcaaaaaacttaaaggagccttctaagcctcagtaaagttaaaggggtgtga

SEQ ID NO: 36577 - DNA, 356 bp, Homo sapiens
acacaggctggtgatgctggagccacaacaaccaccggaaaccccaaggcgaagaccagagaatcccagagatgcagacagagacttcctagagctacagagtaagccaaattggagttgccttttctggacgtcttgttaagtctgatggggttcatcacatctgagccaggactggcttttcttggctgcaagctgaaagttgggtccaggtctgctgtactgagggtctcctatcttccttggacagggacaaccagaggcctatttatctcatgatggaaggcaggagaacaagcaggcaagaccagctgtgctagcacatgccacctctttggccacgtcacacctgctga

SEQ ID NO: 36578 - DNA, 411 bp, Homo sapiens
  misc_feature 367: w=a or t
  misc_feature 376: w=a or t
cagtaaaaactctgaggtatgcatcacttctaaattataaattatcctctgtgaaagagctttactagtaataaatgaaattagaaataaagtgttataattgacctgtttattcattaatctaacatgaattaatagtgacaagtatattttaaaagataatgcccctttatttttttaatttttagttttttagagacggtgtatctctgtgttgctcagtctggtcttgaactcctgtcctgaagcagtcctcctgcctcagcctcccaagtagctggtattacaggtgcaaatcaccatgtctggctgcttctctacagtctcattatctgaactttctttcctaactagaccttaaagtttwtttttcatwaggtggggaaaaaacatctagctgtgctctgggga

SEQ ID NO: 36579 - DNA, 279 bp, Homo sapiens
ccgaagaacaaggggaaggtagccaaggatggagtgaaatgcagggcaaatgtcttaaaggaaatgagaggttctaagaggcgagctcgtggcttgtaacccacatggaagaggttaaaaaggacgatagaatggaatgagcctgtgaggctgaaaggaggtattttccttggtctaagaaccatttgccttgagtagggagggattgatatgtggaaacttcagtgggagagtaagtaggagtgactgatgaggagaaaaactggccatgagggacat

SEQ ID NO: 36580 - DNA, 221 bp, Homo sapiens
  misc_feature 177: n=a, g, c or t
  misc_feature 190: k=g or t
  misc_feature 201: b=c or g or t
  misc_feature 202: r=a or g
  misc_feature 203: v=a or c or g
taattaattcaggttttcagaatacaatcctgtgtttgtgtggattcagaatccacaaactgaaaaccaacgtcactttcccacttgacattcttcttctgtcatttaaggctgaggtgtgcttttgttcttttactgcaatgtatattccaggattgttaaaggatcctcgcttcnaggaggtctctgkgaaataaaacbrvgttaatcccactagactt

SEQ ID NO: 36581 - DNA, 130 bp, Homo sapiens
ctctgtagcgggcgacctaggccgcgggacccggacggaggtagaggccagggcagcgcgtccgggagcggagtccgcgcccgccgccgccatgccggacagctgggacaaggatgtgtaccctgagccg

SEQ ID NO: 36582 - DNA, 52 bp, Homo sapiens
tcagttaatttgcttggaatgtctatgttgaaactttctttttttttttttt

SEQ ID NO: 36583 - DNA, 116 bp, Homo sapiens
agatgggaatcatgatactttccgtgcttaccttgttgaattgttgaataaattaatgaaattaaaagatgctttaaaaactaaactcttatacaaatataactcttggtggcagt

SEQ ID NO: 36584 - DNA, 343 bp, Homo sapiens
  misc_feature 114: n=a, g, c or t
taaatgagggtaggagtcagaaaggaggaattgagagggtgcattccaagcagaaggaagcatgtataaaaaggctgtttggtagaaaggaatcccacagcgtgttcaaagatntgagaaaaggctagtatatcagctgggcatactttcagctttaagtctcgaatatgtgattaacagtgcttaaagaagttgcagtttatttttctcaaacaggaaattcagaggtaagcacttgctctaaatgttggctcaggggctttgccatcagttcttttgacctaaccatgattacagtatagccactggtaactccccatatcacctattcgatcaagtccac

SEQ ID NO: 36585 - DNA, 428 bp, Homo sapiens
  misc_feature 356: m=a or c
tgtagaccctggtcttaattggagagaattacaggcattttattttttgtctctgttttcctctcctactcaaacatttcttttgtcatctgaccattcagtcatgtttcctggtaaaaccacacaagtgagtttgaattgtatttgaatagatctttttggttgagttcctaatttggggggtgaaagtagtaggggcatccccaggttacatgtaaagaatttctattattatccagtacttaagattgctcccattgagtaaggggaagaacttctacttttacagggtgcataagagccacacaaacacacttcatcttaggaagcacttggagaaaactcccaagaaagtmagtgttagcaaaaatggttgatggtgatgcttgactcttatagatgcgagtataccaagatgtctgctcaca

SEQ ID NO: 36586 - DNA, 260 bp, Homo sapiens
  misc_feature 183: n=a, g, c or t
tttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcnggacacttaaaatacttgtgataacagcctttcttgtgatagcagtctgtctgtctgcctgcctgtcttccaccctc

SEQ ID NO: 36587 - DNA, 323 bp, Homo sapiens
  misc_feature 113: m=a or c
  misc_feature 122: r=a or g
  misc_feature 127: w=a or t
  misc_feature 146: m=a or c
cctatattatatctcaaaagaccaaaaacaaacaaaaacttgtaattaactagtagataaaataggggtagaagttgtggtgagaacatgtcacttcctatttccagtaagamccaagtaaratagwaaaaagaaagcagagctgmggaacttggtctgttgggggtgaaggtagctggttgtaggtgtgcagagcaggaatgcatgtaagtgtagatcatctgatcttacccatcggatcgcttgtaacttgatgatactgtttttttgttgtaagactgagaaaaccctgtatttcagtgtcttaaagatacagtgatatt

SEQ ID NO: 36588 - DNA, 189 bp, Homo sapiens
tggggtgtttttaaatccaaatttgtattatgaaaacttacaaacttacagaaaagtgggaagacttgtacagtggacacatatcgacccaattgttaacattttgctatattgctatccacctgttcttccatcaaaccatcttatctttttaatgcagaccttagtactctacacccatgaacacgg

SEQ ID NO: 36589 - DNA, 372 bp, Homo sapiens
  misc_feature 238: w=a or t
  misc_feature 240: w=a or t
  misc_feature 262: w=a or t
  misc_feature 322: w=a or t
  misc_feature 326: w=a or t
catacataaaaacagtggaagacacatccagataatgcaagagctcaaaaaaagattgttcttatattcttccaaacctaagcctaaggaaagcctgagtgtgggcctgggatgaccagcgcagtggccactcgcccatgtggtgggagtattagaaaactgacgaatcccaactgaaatatatcctaagtataaaacacacaccagatttcaaatatggtgttggaaaagaagaatwtwaactatctcattagaaattatwatattgattacatgttgaaatgattttgtatatatcacattaaataaaatttattgaacwaatwttcatctgtttctttttacttttttaaagtgaactagtagaaaata

SEQ ID NO: 36590 - DNA, 340 bp, Homo sapiens
  misc_feature 192: n=a, g, c or t
  misc_feature 249: y=c or t
  misc_feature 291: k=g or t
  misc_feature 293: n=a, g, c or t
  misc_feature 294: n=a, g, c or t
  misc_feature 296: s=g or c
  misc_feature 320: n=a, g, c or t
  misc_feature 321: n=a, g, c or t
cattaaaaactgtgcaagaaacttatgtttcacatatgaagcaacctcagatgtggcatggttttgaacagttgccgaaagtgtgagaaagggaatctgtttgaatattggcacatggatcaagactctggagtcggtgatgagaaaatccaatcagagcattccactttgctattcattgaaccaggtagncaacagaagagttaaaaattagtgatatgactataattcagggggaaggagagctgyaggggggcggcaggaagtcagcagaaaatgcctcatgtcatkanngscaagaaatagtaataaaaggcatnncattgaaaaagggggtggc

SEQ ID NO: 36591 - DNA, 260 bp, Homo sapiens
  misc_feature 193: r=a or g
  misc_feature 232: w=a or t
  misc_feature 237: k=g or t
acagcctgctgggagggcctcctcatgcagttctggaaaggtgaatcggttccttctgcctgtctgggttttgcaaccccgtggtgggacaattggccaggtgcatattcctcagaagcctgctcagcttcggctacctgtcctgggactgggccaagccgagcttcgtggccgacgggcccggggaggctgrcgagcagccctcggccgctccgccccagcctccccacawcatcktcatcctcacggacgaccaaggc

SEQ ID NO: 36592 - DNA, 180 bp, Homo sapiens
gagctgctgaagagcaccattgaagaatggtgagaaggtcggtgcagttaagggaaaggatgtcatggaggggacaggatggagagaaatggtgggaaataagacgagaggtgtaaacacttaacctgggtactctgggtatttaaagtattgtgaagtattgattttgagctttttttt

SEQ ID NO: 36593 - DNA, 248 bp, Homo sapiens
  misc_feature 116: n=a, g, c or t
  misc_feature 117: n=a, g, c or t
  misc_feature 118: n=a, g, c or t
cacaagatataatccatttttatatatcccaaagttgtggcaacagcttctttcttttctgctcaatgccactttgtttcctagtaattcatgaccactattaattctatcattgnnnctgctcctgcttaagatcacttctcaaggatacctcagtaagcaatggataaatcaactttttgttatatgtgccaagtactaagtttcagggttctcttcagcaatcattaattaatacttcagccagt

SEQ ID NO: 36594 - DNA, 150 bp, Homo sapiens
  misc_feature 49: w=a or t
  misc_feature 50: r=a or g
tggattttaatatatagtttgtttttttgttttttttttcgagcacggwrtttcactattgttgcccaggctagagtgcagtggcatgatctcagctccctgcagcctctgcctcctgggttcaagcgatttccctacctcagcccgccg

SEQ ID NO: 36595 - DNA, 173 bp, Homo sapiens
ccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagc

SEQ ID NO: 36596 - DNA, 223 bp, Homo sapiens
ttcaggtgtgcgaaggatcgatcgggaggagaagcgggagctgcaggcactggccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaa

SEQ ID NO: 36597 - DNA, 61 bp, Homo sapiens
  misc_feature 49: w=a or t
  misc_feature 50: r=a or g
tggctgtaggcaatccagtctctccttgctcagtttggtagggaaacawraagttacttcc

SEQ ID NO: 36598 - DNA, 180 bp, Homo sapiens
ctgtacaaaaaataaaagttagctgggtgtggtggcgtgtgcctgtagtcccaattattcaggaggctgaggtaggaggatcacctgagcctgggaggttgaggctgcagtgagccatgatcgcaccactgcactctagcctgggcaacagagtgagaccctgtttcaaaaaaaaaaaaa

SEQ ID NO: 36599 - DNA, 358 bp, Homo sapiens
aatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggc

SEQ ID NO: 36600 - DNA, 189 bp, Homo sapiens
  misc_feature 87: n=a, g, c or t
  misc_feature 121: w=a or t
  misc_feature 122: y=c or t
  misc_feature 127: v=a or c or g
  misc_feature 131: m=a or c
  misc_feature 135: y=c or t
  misc_feature 148: w=a or t
  misc_feature 164: r=a or g
  misc_feature 165: s=g or c
agggcgggctatggcgcaggcgggttgtggggccggcgctggtggcggggcccggtgcatggcggtctgtcggcggagtcgccctcnggggctgtcagatttgtgacccagaaggaaatcwyctgavcctmagcytgtggctcttggwgctggccagaagccarsttcatgtctgagtgcacgagcagc

SEQ ID NO: 36601 - DNA, 246 bp, Homo sapiens
  misc_feature 84: s=g or c
  misc_feature 119: h=a or c or t
  misc_feature 166: y=c or t
tttggggtgaagcagaatgatgatttagggaaggaaagttaacacctggatttggttcttaaggctgggaagttatctgcgaastgacaaggcaaagtgagtgcatttcatcctgggghagcagggttgtgaaataacttggggactctgagcaactttaaatggytctctacttctagagcataagaagttctcttcaggagggatgagaaggagacagagaggcaggatactggaacaggagag

SEQ ID NO: 36602 - DNA, 202 bp, Homo sapiens
  misc_feature 56: s=g or c
  misc_feature 57: m=a or c
cctatcttcatgttatgcaaacggcatcttttcaaaataaactttagaggagtaasmgagaagaatctagtgccctttctgagaaggaatttagctaggagaaccaaatgttgtcccatacactgggttaaaaagaaccagttatgaactacaaatgcagttgactttggccctgagctctatagggaaaagtagggagatg

SEQ ID NO: 36603 - DNA, 364 bp, Homo sapiens
  misc_feature 303: s=g or c
  misc_feature 315: w=a or t
  misc_feature 316: r=a or g
atgttttgttaagaagccgacagaatggtgaaggggccagtgccaaccacagtcctgaaagacactgtaaaccagcggtccccaacctttttggcaccagggaccggtttcttggaagacaatttttccatggatgcaggatgggtaaggatggttttgggatgaaactcttccacctcagattatcaggcattggattcttataaggagcatgcaacctacatccctcaaatgcgcagttcacaatagggtttgcgcttctatgagaacctaatgccatcactgatctgacaggaggcggastcaggcggtcawrcttgctcaccttttgctgtgcacctgggttcctaacaggctgtgcact

SEQ ID NO: 36604 - DNA, 210 bp, Homo sapiens
  misc_feature 46: y=c or t
  misc_feature 54: m=a or c
caaatttctcttgacttacaatctaagtttgcaaaagctgaaatgyaattaagmaataaaatatggcagactgtgtggtcattcctgatgaatgatgtgtctctgctacatgaagtcagtaggagagcccaggacatgagttccactctggtcgttaatcaacctattcacactgtctggagttcctgactgtaataataaatggcactg

SEQ ID NO: 36605 - DNA, 199 bp, Homo sapiens
  misc_feature 48: h=a or c or t
  misc_feature 49: r=a or g
aagaaaattaaataaagaggacaggggcttaaaactggtcagaacgghrtctccagtggtgaggtgacttgaagcggaaaggagttgggactcaacatcctgcatttgtgctttgttttcgaaacttcgagttagttgcattgatgaattaagcagcaggctagtaatggaaaatatttctactgtcctggtggaggag

SEQ ID NO: 36606 - DNA, 174 bp, Homo sapiens
gagaagaaacggcggagacctgagaccgggaggctgaggctgtaggtgggctccgctgggtaaaagttgccgcagcagctgtcccttggccccatcgcgatttatttttcccccttgctttccgggtcccgggatcccaagtttgtaactaacgggagcgaatccacacccact

SEQ ID NO: 36607 - DNA, 89 bp, Homo sapiens
atccgcggccagggacccgcgcaggcccctccttagctgaggggcggccgggtactcgggtcccgacccgcgaccaccgcacccatcgc

SEQ ID NO: 36608 - DNA, 261 bp, Homo sapiens
  misc_feature 214: m=a or c
  misc_feature 256: m=a or c
aatcccgccccacgaatactcgctccgcacccgccggctacccggggataaaacgtttgttcgtagcccctgagactcccaatcaaggatgcaaagtaaaatgccacccgggccaggtaaataatatatgtgaagcagcgacgggatataacgctggtgagtagtgggatgtgatccgactgggagagtgcatttccaccccataagcccccamcacaaagatgagaaagaacagtgctcaaggccctgagtctgmaaccc

SEQ ID NO: 36609 - DNA, 126 bp, Homo sapiens
taatttaaaaaaagctagttcttggaaaaagcacaataatcaaaaccaaatgtacctcattagaaagttcacgtgagataatttgggatttgcaaaattagttttaatcaattgtgaaggacaaca

SEQ ID NO: 36610 - DNA, 162 bp, Homo sapiens
tatccaatctaggcttatctccttgtcttgaaatccatagtaaccttaattacatctgcaaaatctcttttaccatctaaggttacatacaggtttggagattaggacattaacattttacatggaacattattcttgcctactacagttcccacccaccca

SEQ ID NO: 36611 - DNA, 124 bp, Homo sapiens
  misc_feature 124: n=a, g, c or t
gatcgaaaacgcaagcaagaggaacaaatggaaactgagcattttgctctgtaaagcatttcagatgcagcttgtgtgaaatgcattatgcaaaataaagtttattgtattgtattcccagccn

SEQ ID NO: 36612 - DNA, 117 bp, Homo sapiens
tcacacagagttgcatgtctagatagcaaaacagtccttgcctccgagttttatcttgcaaaatttcaaacttaaaagaatgagtacaacaaacagctatgtacaccttccctagat

SEQ ID NO: 36613 - DNA, 226 bp, Homo sapiens
  misc_feature 137: w=a or t
caattgtatatatttttctcttgataaatagctgtatgaaatttgtttcctgaatatttttcttctcttgtacaatatcctgacatcctaccagtatttgtcctaccgggtttttgttgttttctgttctgtataawagtatctaatgttggcaaaaattgaattttttgaagtatacagagtgttatgggttttggaatttgtggacacagatttagaagatccg

SEQ ID NO: 36614 - DNA, 233 bp, Homo sapiens
  misc_feature 122: y=c or t
  misc_feature 136: s=g or c
  misc_feature 140: m=a or c
  misc_feature 157: r=a or g
  misc_feature 169: b=c or g or t
  misc_feature 170: r=a or g
  misc_feature 186: v=a or c or g
gctggttggacgaggggagctggtgggcagggtttgatcccagggcctgggcaacggaggtgtagctggcagcagcgggcaggtgaggaccccatctgccgggcaggtgagtcccttccctyccccaggcctcggstttmcccaggccttctgaaaraaggaggtttabrgggatcgagggctggvcggggagaagcagacaccctcccagcagaggggcaggatgggggcca

SEQ ID NO: 36615 - DNA, 400 bp, Homo sapiens
  misc_feature 119: r=a or g
  misc_feature 121: w=a or t
  misc_feature 133: w=a or t
  misc_feature 352: n=a, g, c or t
  misc_feature 353: n=a, g, c or t
  misc_feature 354: k=g or t
  misc_feature 356: n=a, g, c or t
caattttagaataagtgtgatgaggtgctgagaagaatgtatattctgttgatttgttgtggagagttccgtagatgtctattaggtccgcttggtccagagctgagttcaggtcctgrawaacccttgggtwaaattttctgtcttgttgaatctaatattgacagtggggtgttaaagtctcccaccgttattgtgtgggagtctaagtgtctttgtaggtctctaataacttgctttatgaatctgggtgctcttctattgggtgcatatatatttaggttagttagctcttgttattgcattgatccctttaccattatgtaatgcccttctttgtctctgttgatcnnkangtttggtttaaagtcagttttatcagagactaggattacaacgc

SEQ ID NO: 36616 - DNA, 233 bp, Homo sapiens
  misc_feature 116: w=a or t
  misc_feature 121: h=a or c or t
  misc_feature 123: m=a or c
  misc_feature 124: m=a or c
  misc_feature 127: s=g or c
cgagtagctgggattacaggcatgcgccatgacgccaggctaattttgtatttttagtagagacagggcttctccatgttggtcaggttggtcttgaactcctgacctcaggtgawccgghammacsttgggcctcccaaagtgctgggattacaggcataagcctctgtgcccagctgaaatctagtgtttttttaacagaagttaggagaaagaattgtttttgaaggagt

SEQ ID NO: 36617 - DNA, 329 bp, Homo sapiens
  misc_feature 124: r=a or g
  misc_feature 133: r=a or g
  misc_feature 137: w=a or t
  misc_feature 146: r=a or g
  misc_feature 314: k=g or t
  misc_feature 315: d=a or g or t
cttaataaatttttaatacagaaaaattatcactggcttatcatggctgacgtcataattggaagttttgttcaacactaccaaatgccgtgaagtaaagaaaagtgaatgctgagtaggttarccaggcttrattwagagcattraaggataactcaggatttcagtaagtctggttattatttatatacatcattacaaatctgtttttggggtttcctggcatactgcaacaaataatgtggaagggtattattggaggcaggaatattgatgccattgtaaaccacaaagagcagttaggaggggagaakdtatatacggccaac

SEQ ID NO: 36618 - DNA, 247 bp, Homo sapiens
  misc_feature 146: m=a or c
cccgagaatccccagaaaattgtagagtaatgaatgttaaatggcagtatacttataaaacaaatattgaatcctaaacttggtgctaagagctattcctaacgttgggaataggtctgtaaatgagaacagggaagttcccagcmagcattcatctaggttacagtagagagaaacagtgaaattgtaagaaaaaagacaacttcaagcaccaggtgtgcatatgtgtgtctacaaaacagcgatt

SEQ ID NO: 36619 - DNA, 50 bp, Homo sapiens
  misc_feature 3: k=g or t
tckatcatcccactaccaccatgctggcctcagggatgcttctggtggcc

SEQ ID NO: 36620 - DNA, 257 bp, Homo sapiens
  misc_feature 134: m=a or c
  misc_feature 144: b=c or g or t
  misc_feature 177: d=a or g or t
taacttttacataattgtatataaaaatttattctcttttaataacaattctgttaagttataattcacataggatgcacctatctagagcatgcagctcagtgggttttggtacattcagagagttgtacaamtggtccccgbaccccatctgataacattttcatcaccccagadagaaatgccatccccgtcttagcagtcaagatcgagcagtatctgtcatatatgggaaatcttttaaaaggagatctggg

SEQ ID NO: 36621 - DNA, 121 bp, Homo sapiens
ttgatgtttggcaagagggtaaagtacttagtaattttcaaaaatggtgtgtgggacattgaaaagatacattgtattggtgtgaaatcttttattttcagtgttctgagattcttttttt

SEQ ID NO: 36622 - DNA, 254 bp, Homo sapiens
  misc_feature 114: w=a or t
  misc_feature 122: r=a or g
  misc_feature 133: r=a or g
  misc_feature 143: r=a or g
  misc_feature 219: m=a or c
agcaggcagagccagcatgggatggcggggctggacgtctcaggcacgatcaggcccacgggaaagtcggaggtcagggcgccagggcctctggttgggggcttcagaggcgtwgcagtcgrctcctggagcrgaggaagaarggtgcaggaggtaactttggcctctccaccctccccagcgccccttggcatttgaacgtgtacgacagagagagamagagagagagagaggagccagctggcacggggtca

SEQ ID NO: 36623 - DNA, 267 bp, Homo sapiens
  misc_feature 29: s=g or c
  misc_feature 109: m=a or c
  misc_feature 126: w=a or t
  misc_feature 127: k=g or t
  misc_feature 128: r=a or g
  misc_feature 138: y=c or t
  misc_feature 166: k=g or t
  misc_feature 177: d=a or g or t
  misc_feature 178: k=g or t
tttagtagcgatggagtttctctatgttsgtcaggctggtctggaactccccacctcaggtgatccacccatctcggcctcccaaagtgctgggattacaggtgtgagmcaccgcgccaggcctcwkrttttaaacayttcttaccctgaattacattttgttackttcacttttadktacactaatttcttgatagttgtacattcttgatcattgtcctagaagattcttacagcataaaactatggacttttgagaaagaatgc

SEQ ID NO: 36624 - DNA, 166 bp, Homo sapiens
  misc_feature 129: w=a or t
  misc_feature 160: n=a, g, c or t
tatcctatggttcccctaggctctctgcactttttttaagattttctgttccacagactcaataattgcaactgtcctatctttacgtttgctgatttttcttctgcttgctgaaatctgccttcaaawcctctctagtgtattttttatttcaggtatngtactt

SEQ ID NO: 36625 - DNA, 221 bp, Homo sapiens
  misc_feature 31: r=a or g
  misc_feature 32: s=g or c
  misc_feature 102: r=a or g
  misc_feature 103: s=g or c
  misc_feature 104: n=a, g, c or t
  misc_feature 142: m=a or c
  misc_feature 184: r=a or g
  misc_feature 199: r=a or g
  misc_feature 221: h=a or c or t
agacttggactctaggtccccaaggggcggrsagggtccccactcctggggcagggggagcagagggtggggggctgggttcccgggtccctaacctggggrsngttctggggaccagacgtcgaggttcttaagaagtggmgatgaagaagttttccccgtaactggggcagacgcaggaagrcctgggggaggaaargggcggaaactcagccacatth

SEQ ID NO: 36626 - DNA, 254 bp, Homo sapiens
  misc_feature 14: s=g or c
  misc_feature 15: s=g or c
  misc_feature 101: m=a or c
  misc_feature 115: m=a or c
  misc_feature 129: r=a or g
  misc_feature 131: y=c or t
  misc_feature 134: m=a or c
  misc_feature 135: h=a or c or t
  misc_feature 141: k=g or t
  misc_feature 153: m=a or c
  misc_feature 178: b=c or g or t
  misc_feature 211: y=c or t
  misc_feature 226: m=a or c
caggtgtgtgccassatacccggctaatttttctatttttagtagagctgggttttgccatgttggccaagctggtctcaaattcctgatctcaagtgatmtgcctgcctcagcmtccctaagtgctgrgyatmhaggcgkgagctaccgcamctggcctgatttggaaatatttcabctattttgtgtgttgcattttcattttgttggyagcgtcctttcatgmacaaaagtttttggttctagtgtccagt

SEQ ID NO: 36627 - DNA, 228 bp, Homo sapiens
agactggaggcggagagcgagtgagggctgctagtacattgtcacctctcaccctcagaaggctgagctggtgggggctgagttctgttacgtgtgacagcaacgtctaggccaagcttgtccaacttgccgggcccaccagctgcatacaactctggacggctttgaatgcagcccaacacaaattcgaaaactttcttaaaacatagtgcgttttttttgtttttt

SEQ ID NO: 36628 - DNA, 162 bp, Homo sapiens
  misc_feature 140: r=a or g
  misc_feature 148: m=a or c
  misc_feature 152: w=a or t
tcatttcagcacgagtggctaagagattctctcctgatttgggggcaggccagtcaggcacaagctgcttatctgtgcaactggggcagcttaacccataggccaggaaggcctggctttgggaatcatttcaggggttrtggcccamatcwagtgatgagc

SEQ ID NO: 36629 - DNA, 109 bp, Homo sapiens
  misc_feature 24: s=g or c
  misc_feature 65: k=g or t
  misc_feature 66: n=a, g, c or t
  misc_feature 82: h=a or c or t
gtacgtgaagccgggtgagcgcascggcgggctagggcactaggtcgtcgccccggcctaggctkngggcggttgcggcgchtagtatggaccctctgtctcccccagc

SEQ ID NO: 36630 - DNA, 114 bp, Homo sapiens
tgctttctttttgtgtatgacactatggtgacagtagatcataattttttatagttttttgggggataaactgagttgtttttgttttaaagctaacacttgttaggttctttt

SEQ ID NO: 36631 - DNA, 119 bp, Homo sapiens
  misc_feature 8: r=a or g
  misc_feature 18: w=a or t
  misc_feature 55: d=a or g or t
  misc_feature 59: m=a or c
  misc_feature 70: v=a or c or g
  misc_feature 84: m=a or c
  misc_feature 106: h=a or c or t
  misc_feature 111: s=g or c
ttggacarttcagacttwactaaagcacagttagacccaaggcctatgctgaggdctamacctctgaaavaagtatagtatcgmgtacccgttccctcccagagghgggastaactgct

SEQ ID NO: 36632 - DNA, 173 bp, Homo sapiens
  misc_feature 42: s=g or c
  misc_feature 67: b=c or g or t
  misc_feature 119: w=a or t
  misc_feature 129: k=g or t
  misc_feature 138: k=g or t
  misc_feature 160: y=c or t
ttattattattattattattattattattattattattcagsacagagtatcattcatgttgcccabactggagtgcagtggcgcgatctcggctcactgcagcctccacctcctgggwtcaggcaatkctcctgcckcggcttcctgagtggccgggaytgcgggcaccccc

SEQ ID NO: 36633 - DNA, 227 bp, Homo sapiens
  misc_feature 15: y=c or t
  misc_feature 16: w=a or t
  misc_feature 184: h=a or c or t
  misc_feature 199: n=a, g, c or t
ttcttagtgcagaaywaaatgaaaagtctcccatgtctacttctttctacacagacacggtaaccatccgatttctcaatcttttccccacctttcctgcctttctattccacaaagccgccattgtcatcctggcccgttctcaatgagctgttgggcacacctcccagacagggtggtggchgggcagaggggctcntcacttcccagtaggggcggccgggaag

SEQ ID NO: 36634 - DNA, 248 bp, Homo sapiens
  misc_feature 52: m=a or c
  misc_feature 124: m=a or c
  misc_feature 130: r=a or g
  misc_feature 132: s=g or c
  misc_feature 144: r=a or g
  misc_feature 149: s=g or c
  misc_feature 151: r=a or g
  misc_feature 152: n=a, g, c or t
  misc_feature 243: m=a or c
tggcatgttttatataaatcaattatataatacgtggccttttgtgtctggmttgtgtcatttagcagaagggtccccaaccccagggctgcggataggtactgttccatgaccttttaggaamctgaartsacacagcaggargtgastrncaggtaagtgagcattaccgcctgagttctacctcctgtcagatcagcggtggcattagattctcatagttacgagaaccctgttgtgaamtgtgc

SEQ ID NO: 36635 - DNA, 131 bp, Homo sapiens
  misc_feature 25: m=a or c
  misc_feature 58: k=g or t
  misc_feature 64: r=a or g
  misc_feature 74: k=g or t
  misc_feature 95: k=g or t
  misc_feature 112: r=a or g
ctttaacacccctcacataagatgmtaggtgagagctgacatctgtaggtggcttagkgcctargaaatgtctkcctcactgtgctcttggactktccttctcactcctgaragtgggtggtgttgataat

SEQ ID NO: 36636 - DNA, 141 bp, Homo sapiens
  misc_feature 38: w=a or t
ctcctgcttcagcctccctagtagctgggactacaggwgtgtatcaccacacccagctaatttttgtatttttagtacagatggggttttaacatgttggccaggctggtctcgaactcctgacctcaaataatccaccca

SEQ ID NO: 36637 - DNA, 185 bp, Homo sapiens
cgataatgtcatctcccaagttggatggcagcacgatctggccctagggcagcttcctgttcccagaagtcattgtcctgggctatccagatgtccctagtaaatcttgcttccttctgcaatgttagtaatgccttaagctgacagttgctattttgcagaacagttttcctctttgcttagca

SEQ ID NO: 36638 - DNA, 89 bp, Homo sapiens
  misc_feature 14: w=a or t
  misc_feature 30: m=a or c
  misc_feature 43: m=a or c
  misc_feature 48: w=a or t
  misc_feature 82: h=a or c or t
caacatctggttgwtttgtggattgaatgmaatgatatgtgamgttawtagcatcgtgcctgttacatatacatgtgcagthaataaga

SEQ ID NO: 36639 - DNA, 186 bp, Homo sapiens
  misc_feature 120: n=a, g, c or t
  misc_feature 122: m=a or c
  misc_feature 127: r=a or g
  misc_feature 129: v=a or c or g
  misc_feature 132: r=a or g
  misc_feature 134: m=a or c
  misc_feature 147: w=a or t
  misc_feature 148: r=a or g
  misc_feature 160: d=a or g or t
tcgaaagtgtcgcatcaaactctctggctatgcatgggtcactgcctgctctcacatcttctgtgatcagcatggcagtggtacatcaggaacgtctctatcaagaatacaatttcagcnamggctravggrcmatctgaaacagawrgagaagatatadactcagcaaatacaaagcaaggatgg

SEQ ID NO: 36640 - DNA, 441 bp, Homo sapiens
  misc_feature 248: n=a, g, c or t
  misc_feature 415: v=a or c or g
caggaaacaacaagtgctggagaggatgtggagaaataggaacactcttacactgttggtgggactgtaaactagttcaaccattgtggaagacagcgtggtgattcctcaaggatctaggaatagaaataccatttgacccagccatcccattactcggtatatacccaaaggattataaatcatgctgctataaagacacatgcacacatatgtttattgaggcatcattcacaatatcaaagacntggaacgaacccaaatgtccatcaatgatagactagattaagaaaatgtggcacatatacaccatggaatactatgtagccataaaaaaaggatgagttcatgtcctttgtaaggacatgtatgaagctggaaaccatcattctgagcaaactgtcgcaagaacagvaaaccaaacaccgcatgttctcactc

SEQ ID NO: 36641 - DNA, 76 bp, Homo sapiens
  misc_feature 63: y=c or t
tagaaagagtgacatctttttgatatttagagtctcccaaatttacatagtgagagtacccayaccttttgaatgt

SEQ ID NO: 36642 - DNA, 109 bp, Homo sapiens
  misc_feature 53: s=g or c
  misc_feature 73: s=g or c
  misc_feature 78: m=a or c
gggtgtaattcctgactccagcatgtacatgccgtggggctgtgggtccccasatctctcatgctgccctgasaattmttttgggttgcttattaggtgctaaccctct

SEQ ID NO: 36643 - DNA, 104 bp, Homo sapiens
tatgttttttgtagagataaggtttcaccatgttggccagggtggtcttgaactcctgggctcaagcgatctgcccaccttggcctcccaaagtgctaggattg

SEQ ID NO: 36644 - DNA, 245 bp, Homo sapiens
  misc_feature 129: h=a or c or t
  misc_feature 137: r=a or g
  misc_feature 139: w=a or t
  misc_feature 143: m=a or c
  misc_feature 151: r=a or g
  misc_feature 168: w=a or t
  misc_feature 178: s=g or c
  misc_feature 179: m=a or c
  misc_feature 185: k=g or t
  misc_feature 206: k=g or t
  misc_feature 207: k=g or t
ccctctgtctcatctcctccacttggatgatgctctagcctctgtcagggactgtcccctccaaacttgcttccgtggtctgcctcctagttgaatctcagccctgagtgtccagatctggccaaggthgtctaggrgwggcmcacggggrtgctggaattggcactwcagggccagsmtatgcktgggactggcctgagggtatkktaaagaaaaaaactacataaaaggcctaaaagtaagac

SEQ ID NO: 36645 - DNA, 263 bp, Homo sapiens
caatgatatatttctttattttcacatacactctagctaaaagagcaagagtacacatcaacaaaaaatggaaacaaggctttggctgaaaaaaacatgcatttgacaaatcatgttactagctagacaagaagaaagttagctttgtaaacttctacttcatttgattcagagaaacagagcatgagttttcttagaagtaacaagaaaaggaacaaaaaaaaatgaggtttgaaatcttttaccatggcaaaacattaaca

SEQ ID NO: 36646 - DNA, 138 bp, Homo sapiens
  misc_feature 131: m=a or c
catacaatttccaaaataaattctgtactcaggttgttatatgattttctgagctgaataagttcaggagcagattattaagatctgccattctgaaacgctggtctttttctccttcctatagtggccamccaatag

SEQ ID NO: 36647 - DNA, 252 bp, Homo sapiens
  misc_feature 200: k=g or t
  misc_feature 201: k=g or t
  misc_feature 225: w=a or t
  misc_feature 227: r=a or g
tgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttccckkttgtagagcttttttcctttcctwargccctgtaaataaatgaaggcacaa

SEQ ID NO: 36648 - DNA, 178 bp, Homo sapiens
ggggtcgcggattggaggtttccggttggaaaagccccttggcggctaactggggaggactggaagaaatctaggatggagccagcactgctggcccaacatgtctgtgagagaacctaaaggcgcctccaggaggaagcgtctgcatcttttccttgtttttttttttttttttttt

SEQ ID NO: 36649 - DNA, 252 bp, Homo sapiens
aaaaatgggactaaggcaaatgtctattataagagataggataaaaaatttagtgcatattcatatattgaaataatattgtcaattaaaaaataaaactgatccacatgtgtggaaaataaaatttatttcccaatttaatttgttgaaatttttcaaagactcacaatggtgtgcaggtgaatgcccttttttaataaggaaagatgcatatatgtacatatgtttgtatgtgcagaagtagactggctc

SEQ ID NO: 36650 - DNA, 145 bp, Homo sapiens
agcactttaggaggccgacgtgaggcaggcggatcacttagggtcaggagtttgacaccagcctggccaacctggtaaaaccccatctctattgaaaacacgaaaattagccaggcgtggtggtgagtgcctgtgatcccagcat

SEQ ID NO: 36651 - DNA, 117 bp, Homo sapiens
  misc_feature 69: m=a or c
  misc_feature 116: s=g or c
tgtgtgtgtgtgtgtgtgtgtgtatgttcatgtacacttggctgtcaggctttctgtgcatgtactaamaaaggagaaattataataaattagccgtcttgcggcccctaggccasa

SEQ ID NO: 36652 - DNA, 159 bp, Homo sapiens
atagtttgttttaaagttagaatttagtgtacaaaataaggtaaaaatgacttattaagtagacaggcctactaacataatctgtaccagaagagagaaaacaaggaaaagaagcctcacatttgtgggtatgatatttatgctggacacatgggcacc

SEQ ID NO: 36653 - DNA, 54 bp, Homo sapiens
taatattatgttcatatgctgtcctgtgcaatttcttttttttttttttttttt

SEQ ID NO: 36654 - DNA, 243 bp, Homo sapiens
ttagtaagaaatgttcagcaaagagctcattttaggtgtatgactcaccttctgtagccagttctccctcttttttttttaagctagtggttattccccagacagagagaatcctgcctcacctttgatcgtttccttgaacaacatctcaactttgcactaatccttttatctccatcttttaactctattaaatagagttaaaaaggtgtgagctaccttttttctaaccacagggcattt

SEQ ID NO: 36655 - DNA, 271 bp, Homo sapiens
tacattttggatgtatgaaagaaaacttgaccatttgaagatatatgaataaagaaatgtactatagatactactttaggaaaacactgtttggtaagtgttccagtctgatattttaagtgtgtacttcctatacttgtataaaaatctttgatgtttgcaacaatactgtgatttttttaagtggatttcttttgcaagtgaacatgatcattgaaagttgatatggcagtttccaggaaataaatgcattctttgtagaatgggggtg

SEQ ID NO: 36656 - DNA, 267 bp, Homo sapiens
tattttttattgtatcttatttcttcttttttggggtagggtcttcctctgttgcccaggctggagtacagtggtgtgatcatagctcactgcagacttgacctcctggttggggagtggtggtgtgcaccagtggtcccagctactcaggaggctgaagcagagggacccccccagcccgggaggcgctccagaacaccccagcttgggtgacagagtgagaatctttctcaaaaaataaataagtaaataaagttgcttgggaat

SEQ ID NO: 36657 - DNA, 350 bp, Homo sapiens
  misc_feature 127: r=a or g
  misc_feature 128: b=c or g or t
  misc_feature 129: y=c or t
gggatagtttaaaaatgatggtagggctagagatggaatccatgattgaggaggactgtagattttacttaactatattctttctttttaatttatttttattttattttattttttttgagacgarbycgctctgtctcccaggctggagtgcagtggcgccatgccgtctcactgcaacctccgcattccagattcaagtgattcttctgcctcagcctcccaggtagctggggctacaggcgccggcgccaccacgcccggctaatttttgtatttttagtagagacgaagtttcaccatgttagtcaggctggtctcgaactcctgaccttggatccgccctccct

SEQ ID NO: 36658 - DNA, 178 bp, Homo sapiens
  misc_feature 118: n=a, g, c or t
  misc_feature 119: n=a, g, c or t
tacagagttcatatggaagtagaggagaaacaggtctaatttgggtgtgatgccctgtattagtctgttttcatgctgctaataaagacatacccaagcctaggtaatttataaagannaagaggtttaatggactcacagttccacgtggctggggaggcttcacaatcatggtgga

SEQ ID NO: 36659 - DNA, 52 bp, Homo sapiens
aaaacaagaatggcaagatgaaagtataaactaaaaatatttttggaagttt

SEQ ID NO: 36660 - DNA, 212 bp, Homo sapiens
  misc_feature 186: r=a or g
ctttaaaaaaaccaattgaggaatgtgtttcaagtgttctataatgaaacacttgctttttattctgtggctcacaataaaaggctttagtgtttagggttgtgtttagtaatgtgcaactcagatttgtttgatgaaaagatggtttatggcttgcaaatagcaccctgaataaagtttctttgragcaattccttcacttgtccctgacc

SEQ ID NO: 36661 - DNA, 146 bp, Homo sapiens
ccttttggttgataaaaatctgcatataagtggaccagctcagttaaaacctcaagagtcaactgtatatttatttctgtttctgtctatatatattgaaaaccacaagttcactttggtacttccaattcttttttttttttttt

SEQ ID NO: 36662 - DNA, 135 bp, Homo sapiens
  misc_feature 16: m=a or c
ccatttgaaatttagmtgaagttatactattagaaaactacaacttaacagacacagcagaaaatagaaaatctgaatagtcctattaaacatgatccttagtggaaagagctacccactagttttgaagtcttt

SEQ ID NO: 36663 - DNA, 139 bp, Homo sapiens
  misc_feature 136: m=a or c
atagtttctgtactttagcagaacaggaaggatatttgttcattaaaggtggcttggtcttacagctgggtgcagtggtatatacctgtagtcccagctactcaggaagctgaggtgagaggatctctagaggccmaga

SEQ ID NO: 36664 - DNA, 137 bp, Homo sapiens
  misc_feature 42: k=g or t
  misc_feature 64: k=g or t
  misc_feature 135: s=g or c
cggcattacattccatccagcctgggcgacaagagcaaaatkccatctcgaaaaatcaccaggkacatacctctcaagtttgataagtccatcttttgagttttcttttagctctttcaaaagattacgaggggscg

SEQ ID NO: 36665 - DNA, 114 bp, Homo sapiens
tgatgttagcattagggaagctgggtaaggctgtacagggactctgaactatttttgcaacttttttgtaagtctgaagtttaaaaaaggaacctaacagatgagcacagtcct

SEQ ID NO: 36666 - DNA, 115 bp, Homo sapiens
taggttgaaagactttattccagagaaatgtaaacattccctgtaatactaatgagcaggaattaagaagagacaagctagttttgaaatggagatttatttttttttttttttt

SEQ ID NO: 36667 - DNA, 116 bp, Homo sapiens
  misc_feature 74: d=a or g or t
ccgccatgagaatcacacagagtcttctgtaggggtatggtgcgccgcatgacatgggaggcgatggggacgadggacagagacagagcgtgcacacgtagagtggctagtgaagg

SEQ ID NO: 36668 - DNA, 225 bp, Homo sapiens
  misc_feature 129: w=a or t
  misc_feature 131: w=a or t
cctctttgctcagatcacctcaaagattgatgatattaaaattaattttcaggaatgtttccttatttgattgctatcatattagttccctttcccttccatgaacttatccacagttatcatttcctwawatgttgtcagcaaaacctctgctattttctgggggaatagagattagctattttgactacctgtaaattcaacaaatgtgagttagacccatgc

SEQ ID NO: 36669 - DNA, 356 bp, Homo sapiens
  misc_feature 206: n=a, g, c or t
tatagataatgctcagatgaacttctttgtatgcttggactttgacaaaaattctgtcaaagtatttaatcagatgtcccagtattagattactagttcaagctctgcctcctgggttcacgctgttctcctgcctcatcctcccaagtagctgggactacaggtgtccaccaccagactggctaattttttgtatttttagtacngacggggtttcaccgtgttagccaggatggtctcgatctcctgatcttgtgatctgcccgtctcggcctcccaaagtgctgggattacaggcatgagccactgtgcccggccaaaagatttttttttactttaacataaaatagcctacc

SEQ ID NO: 36670 - DNA, 135 bp, Homo sapiens
  misc_feature 127: y=c or t
ttttttggaacttgtgtagttttcattagtgtttggatgaaatttgttatacttgaaagctatgtatttaattgttttatacaatagttggaaagtgatattgcccccttgtggctacttacaccaytggcacgg

SEQ ID NO: 36671 - DNA, 428 bp, Homo sapiens
  misc_feature 128: m=a or c
  misc_feature 129: y=c or t
  misc_feature 261: w=a or t
  misc_feature 262: n=a, g, c or t
  misc_feature 368: m=a or c
  misc_feature 391: m=a or c
  misc_feature 397: n=a, g, c or t
gagcccaaagcacttggctgccctgcgtgtcactcatctccctttgcctcccagctggagtccctggatgccctagagcctgaggagaaggctgaggactgctgggagctacagatcagcccggaagmyactggctcatgggcgccaaaaaatactggatctgctgaacgaaggctcagcccgagatctccgcagtcttcagcgcattggcccgaagaaggcccagctaatcgtgggctggcgggagctccacggcccctwnagccaggtggaggacctggaacgcgtggagggcataacggggaaacagatggagtccttcctgaaggcaaacatcctgggtctcgccgccggccaagcgctgtggmgctcctgaccgtcgtctcctcamgtccgnattttcaaatttttgtatacccccgtgttgt

SEQ ID NO: 36672 - DNA, 109 bp, Homo sapiens
agatggtgtcccaggactgcaagtaactgcgtacatccacacagcgcattacaccaacctgagaagaatccttgcgtgaccggattgtttctgaacctgccaagcccac

SEQ ID NO: 36673 - DNA, 239 bp, Homo sapiens
  misc_feature 108: h=a or c or t
  misc_feature 156: v=a or c or g
  misc_feature 212: k=g or t
ctgcgcgagggcgagacgaaggccgtgaagacggtccgcacccccggggccgcggcgaacctcgagctgatcttcgtggggccccagcacgccggcaactacaggtghcgctaccgctcctgggtgccccacaccttcgaatcggagctcagcgavcctgtggagctcctggtggcagaaagctgatgcagccgcgggcccagggtgctgtkggtgtcctcagaagtgccggggattct

SEQ ID NO: 36674 - DNA, 361 bp, Homo sapiens
  misc_feature 302: r=a or g
tttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatrtttatgtctgcaacaattgtctcaaaataataaactgtgcaattcttgtcattaaaaaa

SEQ ID NO: 36675 - DNA, 123 bp, Homo sapiens
  misc_feature 15: y=c or t
  misc_feature 16: w=a or t
  misc_feature 18: w=a or t
  misc_feature 26: w=a or t
tagtagtgaaggggywtwaccatgtwgggcaggctggtcttgaactcctgacctcaggtgatctgcccgcctcagcctcccacagtgctgggattacaggtatgagccaccacgcccgggcca

SEQ ID NO: 36676 - DNA, 168 bp, Homo sapiens
  misc_feature 32: w=a or t
  misc_feature 142: y=c or t
  misc_feature 168: r=a or g
tattgcagcatacctgagttgtttcatttttwaatttttgaccaatttgggtttgtttggggtggatccgggacagagaagggagaaaccctgagggcaacatggagagccccagggagacgcgcaccccatgacttgcttytatttgcgttccagtggctcgctggr

SEQ ID NO: 36677 - DNA, 320 bp, Homo sapiens
  misc_feature 158: w=a or t
ttccttcttgatgagaggggcgtacacacatgctgtgatatttatttgcgattctctgaggtgggagatggttcttgagcctaaagctggaaaattcctacaatgcataagtttaaaatagctcttaatattttctctgaaaatgtttttatttgaawgtattatttttgcttttctaagcaaaaataactgactgaattgcctaggaaagaaaagctccagattcagatcccaggtctgtggtaaaaatcatcttttccagttatttttttctgtgtactgtatttaaatctactttaagaattgttgtcagagcccct

SEQ ID NO: 36678 - DNA, 238 bp, Homo sapiens
  misc_feature 65: m=a or c
  misc_feature 73: y=c or t
  misc_feature 76: y=c or t
  misc_feature 83: m=a or c
  misc_feature 88: m=a or c
  misc_feature 96: r=a or g
ctttttgaggcagctaccagaagggagcaccaagcagatgcagctccccttccctcccattccamcatccaaytgyccccagmaagamcctgcggragggtggcccaatggggagaaaactaaggattcggtgttgggaccactcctgccctgacctgccctgtgactccgtcatactctccaaaggccagaccctcctagaccagctggaaccaccatcaagatgtccccagcccat

SEQ ID NO: 36679 - DNA, 211 bp, Homo sapiens
tacttgtttttagacatttctcttgggaagttgtgcatctgacaggaatatagtactgtacgatatgaggcaagctactcctttgaaaaaggttatcttagatatgagaacaaatacaatctgttggaaccctatggaaagctttcatttttacagcagcaaatgaagattataacttatatacttttgatatgcgtgcactggacacccc

SEQ ID NO: 36680 - DNA, 244 bp, Homo sapiens
  misc_feature 121: m=a or c
  misc_feature 123: v=a or c or g
  misc_feature 124: d=a or g or t
  misc_feature 130: d=a or g or t
  misc_feature 138: b=c or g or t
  misc_feature 139: w=a or t
  misc_feature 144: w=a or t
  misc_feature 147: w=a or t
  misc_feature 152: m=a or c
  misc_feature 192: m=a or c
gaacaaataataagtctccatatgttcatgtatgcttgtatgtatttgtatgaacatagaaaaagatagaagtatatataccagttaacaactgttacttttctggtggagtgggaatgcmavdaatcadtaaatttbwatatwtawggaamatttacctcataacaatcttttgaatttagagaacactgmataatttgaactgggctatgtaaggttaaagaaatctgataatgacagcaca

SEQ ID NO: 36681 - DNA, 68 bp, Homo sapiens
  misc_feature 66: m=a or c
atcccgctgcgaccggcgctccccggggcaggtggctgcatagtcttggcggaggtgaccaaagcmac
